United States Patent 7,745,391 (HUMAN THROMBOSPONDIN POLYPEPTIDE) - sequence listing, part 82

SEQ ID NO: 285436 - DNA, 368 bp, Homo sapiens
gtttcgtgacatttcttagctgttcctaaaagacatgtgaagcttcacatggctgggtttggtaataccatccaagaggctggggctgcgaatataatttgtaattttgattattttttttagaagccgaacaaactgaaaggaacattcaccccactgcaatgatgtttaccagcactattaacttactgcagactctttgtctgtctgctggagttcatgctgagatcatgcagagcgaagccaccaagactttatgcggactgctgcgaatgttagtggaaagcggaacgacggacaagacatgtatggaatgagagatcgagggcccagggagtcagcgctgggggccgcacgcttgtgtctgg

SEQ ID NO: 285437 - DNA, 14138 bp, Homo sapiens
ccacctcccggggtcaagcaattctcatgcctcagctggattatagatattcaccaccatgcctggctaatttctgtatttttagtacagacagggttttgccatgttgcccaggctggtctcgaactcctgggctcaagtgatccgcccgccttggcctcccaaagttctgggattacaggtgtgagctaccatgcccagcctaacaattctgttttttagcaattcactttaagtttttgcaaagttttcagcttagttttcaccataaaaataaaaatatttacttttgcaattgcattttatccctttatgtaatatttaatcaacttacataattatgctgatatgcagttgggaacacatacagtggtacagttgaccaccggtcagcatggtggcaacagaagcaggcaggcaaacgggagggtggtccgcaagcatctgcaatgtgccaggccccagttactgtgtgttatggaggcagtgggcctttggttctgtgaagcagttaacattgagcccaggctagtaagagtcaggactttgtttttcatggaatgaaaacaaaaagaaaactcagctttccctttctttattgcttctatgtcaacctcaagtgtcacctagatttcgtttgctcagtagccacccttgtagtgttaactatgtacctgagtggtctagattagtgtgcgtttttcattatattatttgcagtcatttaaaatttttcgttaaaatgcagagttgttgttatttaaatgcatttgtattttttagggcaagtgtggtcttggggagatggtgactatgggaaattgggcagaggtggtagtgatggctgcaaaaccccaaagctgattgaaaagcttcaagacttggatgtggtcaaagtccgctgtggaagtcagttttccattgctttgacgaaagatggccaagtttattcatggggaaaaggtgacaaccagagacttggacatggaacagaggaacatgttcgttatccaaaactcttagaaggcttgcaagggaagaaggtgattgatgtggctgcaggctccacccactgcctggctctgactgaggacagcgaggtccacagctgggggagcaacgaccagtgccagcactttgacaccttgcgcgtgaccaagccagaacctgcagcattgccaggactggacaccaaacacatagtgggaattgcctgtgggcctgcccagagctttgcttggtcatcatgttctgagtggtccattggcctccgtgtcccttttgtggtggacatctgctcaatgacttttgagcagctagatctcctgcttcggcaggtgagtgaggggatggatggctccgcggactggcccccgccccaggagaaagagtgtgtggccgtggcaacgctgaatcttctacgacttcagttgcatgctgccattagtcaccaggttgacccggaattccttggtttaggtctgggcagcatcctcctgaacagcctgaagcagacggtggtgaccctggccagcagtgcgggcgtgctgagcaccgtgcagtcggccgcccaggccgtgctgcagagtggctggtccgtgctgctgcccaccgcggaggagcgggcccgggcactctctgctctcctgccctgcgcagtttcaggcaatgaagtgaacataagtccaggtcgtcgattcatgattgatcttctggtgggcagcttgatggctgatggagggttggagtcagccttacacgcagccattactgcagagatccaggatattgaagccaaaaaagaagcacagaaggaaaaagaaattgatgaacaggaagcgaatgcctcaacatttcatagaagcaggactccactggataaagaccttattaatacggggatctgtgagtcttctggcaaacagtgtttgcctctggttcagctcatacaacagcttcttagaaacatcgcttctcagactgtagccagattgaaagatgttgcccgtcggatttcatcatgtctggactttgagcaacacagtcgtgaaagatctgcttcattggattggttactgcgtttccaacgtttgcttattagtaaactttatccaggagaaagtattggtcagacctcagatatttctagtccagagctaatgggtgttggttccttgctgaagaagtacacagccctcctgtgcacgcacattggagatatactgcctgtggccgccagcattgcttctaccagctggcggcacttcgcggaggtggcttacattgtggaaggggactttactggtgttctccttccagaactagtagtttctatagtgcttctgctcagtaaaaatgctgatctcatgcaagaggctggagctgtacctctgctgggtggcctgttggaacatctggatcggttcaaccatctggcaccaggaaaggaacgggatgatcatgaagagttagcctggcctggcataatggagtcattttttacaggtcagaactgtagaaataatgaggaagtgacacttatacgcaaagctgatttggagaaccataataaagatggaggcttctggactgtgattgacgggaaggtgtatgatataaaggacttccagacacagtcgttaacaggaaatagtattcttgctcagtttgcaggggaagacccagtggtagctttggaagctgctttgcagtttgaagacacccgggaatccatgcacgcgttttgtgttggccagtatttggagcctgaccaagaaatcgtcaccataccagatctggggagtctctcttcacctctgatagacacagagaggaatctgggcctgcttctcggattacacgcttcgtatttggcaatgagcacaccgctgtctcctgtcgagattgaatgtgccaaatggcttcagtcatccatcttctctggaggcctgcagaccagccagatccactacaggtacaacgaggagaaagacgaggaccactgcagctccccagggggcacacctgccagcaaatctcgactctgctcccacagacgggccctgggggaccattcccaggcatttctgcaagccattgcagacaacaacattcaggatcacaacgtgaaggactttttgtgtcaaatagaaaggtactgtaggcagtgccatttgaccacaccgatcatgtttccccccgagcatcccgtggaagaggtcggtcgcttgttgttatgttgcctcttaaaacatgaagatttaggtcatgtggcattatctttagttcatgcaggtgcacttggtattgagcaagtaaagcacagaacgttgcctaagtcagtggtggatgtttgtagagttgtctaccaagcaaaatgttcgctcattaagactcatcaagaacagggccgttcttacaaggaggtctgcgctcctgtcatcgaacgtttgagattcctctttaatgaattgagacctgctgtttgtaatgacctctctataatgtctaagtttaaattgttaagttctttgccccgttggaggaggatagctcaaaagataattcgagaacgaaggaaaaagagagttcctaagaagccagaatctatggatgatgaagaaaaaattggaaacgaagagagtgatttagaagaagcttgcattttgcctcatagtccaataaatgtggacaagagacccattgcaattaaatcacccaaggacaaatggcagccgctgttgagtactgttacaggtgttcacaaatacaagtggttgaagcagaatgtgcagggtctttatccgcagtctccactcctcagtacaattgctgaatttgcccttaaagaagagccagtggatgtggaaaaaatgagaaagtgcctactaaaacagttggagagagcagaggttcgcctggaagggatagatacaattttaaaactggcgagcaagaatttcttacttccatctgtgcagtatgcgatgttttgtggatggcaaagacttattcctgagggaatcgatataggggaacctcttactgattgtttaaaggatgttgatttgatcccgccttttaatcggatgctgctggaagtcacctttggcaagctgtacgcttgggctgtacagaacattcgaaatgttttgatggatgccagtgccacatttaaagagcttggtatccagccggttcccctccaaaccatcaccaatgagaacccgtcaggaccgagcctggggaccatcccgcaagcccgcttcctcctggtgatgctcagcatgctcaccctgcagcacggcgcaaacaacctcgaccttctgctcaattccggcatgctggccctcacgcagacggcactgcgcctgattggccccagttgtgacaacgttgaggaagatatgaatgcttctgctcaaggtgcttctgccacagttttggaagaaacaaggaaggaaacggctcctgtgcagctccctgtttcaggaccagaactggctgccatgatgaagattggaacaagggtcatgagaggtgtggactggaaatggggcgatcaggatgggcctcctccaggcctaggccgcgtgattggtgagctgggagaggacggatggataagagtccagtgggacacaggcagcaccaactcctacaggatggggaaagaaggaaaatacgacctcaagctggcagagctgccggctgctgcacagccctcagcagaggattcggacacagaggatgactctgaagccgaacaaactgaaaggaacattcaccccactgcaatgatgtttaccagcactattaacttactgcagactctttgtctgtctgctggagttcatgctgagatcatgcagagcgaagccaccaagactttatgcggactgctgcgaatgttagtggaaagcggaacgacggacaagacatcttctccaaacaggctggtgtacagggagcaacaccggagctggtgcacgctggggtttgtgcggagcatcgctctcacgccgcaggtatgcggcgccctcagctccccgcagtggatcacgctgctcatgaaggtcgtggaagggcacgcacccttcactgccacctcgctgcagaggcagatcttagctgtgcatttgttgcaagcagtccttccatcatgggacaagaccgaaagggcgagggacatgaaatgcctcgtggagaagctgtttgacttcttgggaagcttgctcactacctgctcctctgacgtgccattactcagagagtccacgctgaggcggcgcagggtgcgcccgcaggcctcgctgactgccacccacagcagcacactggcggaggaggtggtggcactgctgcgcacgctgcactccctgactcagtggaatgggctcatcaacaagtacatcaactcccagctccgctccatcacccacagctttgtgggaaggccttccgaaggggcccagttagaggactacttccccgactccgagaaccctgaagtggggggcctcatggcagtcctggctgtgattggaggcatcgatggtcgcctgcgcctgggcggtcaagttatgcacgatgagtttggagaaggcactgtgactcgcatcaccccaaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggtgccagcagttgaagctatacatcctgaaagcaggtcgggcgctgctctcccaccaggataaactgcggcagatcctgtctcagccagctgttcaggagactggaactgttcacacagatgatggagcagtggtatcacctgaccttggggacatgtctcctgaagggccgcagccccccatgatcctcttgcagcagctgctggcctcggccacccagccgtctcctgtgaaggccatatttgataaacaggaacttgaggctgctgcactggccgtttgccagtgcttggctgtggagtccactcacccttcgagcccaggatttgaagactgcagctccagtgaggccaccacgcctgtcgccgtgcagcacatccgccctgccagagtgaagaggcgcaagcagtcgcccgttcccgctctgccgatcgtggtgcagctcatggagatgggattttccagaaggaacatcgagtttgccctgaagtctctcactggtgcttccgggaatgcatccagcttgcctggtgtggaagccttggtcgggtggctgctggaccactccgacatacaggtcacggagctctcagatgcagacacggtgtccgacgagtattctgacgaggaggtggtggaggacgtggatgatgccgcctactccatgtctactggtgctgttgtgacggagagccagacgtacaaaaaacgagctgatttcttgagtaatgatgattatgctgtatatgtgagagagaatattcaggtgggaatgatggttagatgctgccgagcgtatgaagaagtgtgcgaaggtgatgttggcaaagtcatcaagctggacagagatggattgcatgatctcaatgtgcagtgtgactggcagcagaaagggggcacctactgggttaggtacattcatgtggaacttataggctatcctccaccaagttcttcttctcacatcaagattggtgataaagtgcgggtcaaagcctctgtcaccacaccaaaatacaaatggggatctgtgactcatcagagtgtgggggttgtgaaagctttcagtgccaatggaaaagatatcattgtcgactttccccagcagtctcactggactgggttgctatcagaaatggagttggtacccagtattcatcctggggttacgtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggtcagtctgcggtattttgtggccgttctggaaaacagctgaagcgttgccacagcagccagccaggcatgctgctggacagctggtcccgcatggtgaagagcctgaatgtgtcgtcctccgtgaaccaggcatcccgtctcattgacggcagcgagccctgctggcagtcatcggggtcgcaaggaaagcactggattcgtttggagattttcccagatgttcttgttcatagattaaaaatgatcgtagatcctgctgacagtagctacatgccgtccctggttgtagtgtcaggtggaaattccctgaataaccttattgaactaaagacaatcaatattaacccttctgacaccacagtgccccttctgaatgactacacagagtatcacaggtatattgaaattgctataaagcagtgcaggagctcaggaatcgattgtaaaatccatggtctcatcctgctgggacggatccgtgcagaagaggaagatttggctgcagttcctttcttagcttcggataatgaagaggaggaggatgagaaaggcaacagcggaagcctcattagaaagaaggctgctgggctggaatcagcagctacgataagaaccaaggtgtttgtgtggggcctgaatgacaaggaccagctgggcgggctgaaaggctccaagataaaggttccttcgttctctgagacactgtcagctttgaatgtggtacaggtggctggtggatctaaaagtttgtttgcagtgactgtggaagggaaggtgtatgcctgtggagaagccacgaatggccggctggggctgggcatttccagcgggacggtgcccatcccacggcagatcacagctctcagcagctacgtggtcaagaaggtggctgttcactcaggtggccggcacgcgacggctttaactgtcgatggaaaagtgttttcgtggggcgaaggtgacgatggaaaacttggacacttcagcagaatgaactgtgacaaaccaaggctgatcgaggccctgaaaaccaagcgtatccgggatatcgcctgtgggagctcgcacagcgcagccctcacatccagcggagaactgtacacctggggcctcggcgagtacggccggctgggacatggggataatacgacacagctaaagcccaaaatggtgaaagtccttctcggtcacagagtaatccaggttgcatgtgggagtagagacgcgcagaccctggctctgaccgatgaaggtttggtattttcctggggtgatggtgactttggaaaactgggccggggcggaagtgaaggctgtaacattccccagaacattgagagactaaatggacagggggtgtgccagattgagtgtggagctcagttctccctggcgctcaccaagtctggagtggtgtggacatggggaaagggggattacttcagattgggccacggctctgacgtgcacgtgcggaaaccacaggtggtggaagggctgagagggaagaagatcgtgcatgtggctgtcggggccctgcactgcctggcggtcacggactcggggcaggtgtatgcttggggtgacaacgaccacggccagcagggcaatggcacgaccacggttaacaggaagcccacactcgtgcaaggcttagaaggccagaagatcacacgcgtggcttgtgggtcgtcccacagtgtggcgtggacaactgtggatgtggccacgccctctgtccacgagcccgtcctcttccagactgcaagagacccgttaggtgcttcctacttaggcgtgccctcagatgctgattcttctgctgccagtaataaaataagtggtgcaagtaattctaagccaaatcgcccttctcttgccaagattctcttgtcattggatggaaatctggccaaacagcaggccttatcgcatattcttacagcattgcaaatcatgtatgccagagatgctgttgtcggggccctgatgccggccgccatgatcgccccggtggagtgcccctcgttctcctcggcggccccttccgacgcatctgcgatggctagtcccatgaatggagaagaatgcatgctggctgttgatatcgaagacagactgagtccaaatccatggcaagaaaagagagagattgtttcctctgaggacgcagtgaccccctctgcagtgactccgtcggccccctcagcctccgctcggccttttatcccagtgacggatgacctgggagctgcaagcatcattgcagaaaccatgaccaaaaccaaagaggatgttgaaagccaaaataaagcagcaggtccggagcctcaggccttggatgagttcaccagtctgctgattgcggatgacactcgtgtggtggtagacctgctcaagctgtcagtgtgcagccgggccggggacaggggcagggatgtgctctccgcggtgctttccggcatggggaccgcctacccacaggtggcagatatgctgttggagctctgtgtcaccgagttggaggatgtggccacagactcgcagagcggccgcctctcttctcagcctgtggtggtggagagtagccacccttacaccgacgacacctccaccagtggcacagtgaagataccaggtgcagaaggactcagggtagaatttgaccggcagtgctccacagagaggcgccacgaccctctcacagtcatggacggcgtcaacaggatcgtctccgtgcggtcaggccgagagtggtccgactggtccagcgagctgcgcatcccaggggatgagttaaagtggaagttcatcagcgatgggtctgtgaatggctggggctggcgcttcaccgtctatcccatcatgccagctgctggccctaaagaactcctctctgaccgctgcgtcctctcctgtccatccatggacttggtgacgtgtctgttagacttccgactcaaccttgcctctaacagaagcatcgtccctcgccttgcggcctcgctggcagcttgtgcacagctgagtgccctagctgccagtcacagaatgtgggcccttcagagactgaggaagctgcttacaactgaatttgggcagtcaattaacataaataggctgcttggagaaaatgatggggaaacaagagctttgagttttacaggtagtgctcttgctgctttggtgaaaggtcttccagaagctttgcaaaggcagtttgaatatgaagatcctattgtgaggggtggcaaacagctgctccacagcccattctttaaggtactagtagctcttgcttgtgacctggagctggacactctgccttgctgtgccgagacgcacaagtgggcctggttccggaggtactgcatggcctcccgtgttgctgtggcccttgacaaaagaacaccgttgccccgtctgtttcttgatgaggtggctaagaaaattcgtgaattaatggcagacagcgaaaacatggatgttctgcatgagagccatgacatttttaaaagagagcaagacgaacaacttgtgcagtggatgaacaggcgaccagatgactggactctctctgctggtggcagtggaacaatttatggatggggacataatcacaggggccagctcgggggcattgaaggcgcaaaagtcaaagttcccactccctgtgaagcccttgcaactctcagacccgtgcagttaatcggaggggaacagaccctctttgctgtgacggctgatgggaagctgtatgccactgggtatggtgcaggtggcagactaggcattggagggacagagtcggtgtccaccccaacattgcttgaatccattcagcatgtgtttattaagaaagtagctgtgaactctggaggaaagcactgccttgccctgtcttcagaaggagaagtttactcttggggtgaggcagaagatgggaagttggggcatggcaacagaagtccgtgtgaccgccctcgtgtcatcgagtctctgagaggaattgaagtggtcgatgttgctgctggcggagcccacagcgcctgtgtcacagcagccggggacctctacacatggggcaaaggccgctacggccggctggggcacagcgacagtgaggaccagctgaagccgaagctggtggaggcgctgcagggccaccgtgtggttgacatcgcctgtggcagtggagatgcccagaccctctgcctcacagatgacgacactgtctggtcctggggggacggggactacggcaagctcggccggggaggcagcgatggctgtaaagtgcctatgaagattgattctcttactggtcttggagtagttaaagtggaatgcggatcccagttttctgttgcccttaccaaatctggagctgtttatacctggggcaaaggcgattatcacaggttgggccatggatcagatgaccatgttcgaaggcctcggcaggtccaagggttgcaggggaagaaagtcatcgccatcgccactggctccctgcactgtgtgtgctgcacagaggatggtgaggtttatacatggggcgacaatgatgagggacaactgggagacggaaccaccaatgccatccagaggcctcggttggtagctgcccttcagggtaagaaggtcaaccgtgtggcctgtggctcagcacataccctcgcctggtcgaccagcaagcccgccagtgctggcaaactccctgcacaggtccccatggagtacaatcacctgcaggagatccccatcattgcgctgaggaaccgtctgctgctgctgcaccacctctccgagctcttctgcccctgcatccccatgttcgacctggaaggctcgctcgacgaaactggactcgggccttctgttgggttcgacactctccgaggaattctgatatcccagggaaaggaggcggctttccggaaagtagtacaagcaactatggtacgcgatcgtcagcatggccccgtcgtggagctgaaccgcatccaggtcaaacgatcaaggagcaaaggcgggctggccggccccgacggcaccaagtctgtctttgggcagatgtgtgctaagatgagctcgtttggtcccgacagcctcctccttcctcaccgtgtctggaaagtcaagtttgtgggtgaatctgtggatgactgtgggggcggctacagcgagtccatagctgagatctgtgaggagctgcagaacggactcacgcccctgctgatcgtgacacccaacgggagggatgagtctggggccaaccgagactgctacctgctcagcccggccgccagagcacccgtgcacagcagcatgttccgcttcctgggtgtgttgctgggcattgccatccgaaccgggagtcccctgagcctcaaccttgccgagcctgtctggaagcagctggctgggatgagcctcaccatcgcggacctcagtgaggttgataaggattttattcctggactcatgtacatccgagacaatgaagccacctcagaggagtttgaagccatgagcctgcccttcacagtgccaagtgccagtggccaggacattcagttgagctccaagcacacacacatcaccctggacaaccgcgcggagtacgtgcggctggcgataaactatagactccatgaatttgatgagcaggtggctgctgttcgggaaggaatggcccgcgttgtgcctgttcccctcctctctctgttcaccggctacgaactggagacgatggtgtgtggcagccctgacatcccgctgcaccttctcaagtcggtggccacctataaaggcatcgagccttccgcatcgctgatccagtggttctgggaggtgatggagtccttctccaacacagagcgctctcttttccttcgcttcgtctggggccggacgaggctgcccaggaccatcgccgacttccggggccgagacttcgtcatccaggtgttggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagccagccgccgacgacagcagcgacgattcagataacgaggatgtcgactcctttgcttcggactctacacaagattatttaacaggacactaagatggggaaacgtcctcgtgagatgagagcctgagccaggcagcagagcactcgctgctgtgtagactgtaggctgcctggtgtgtctgatgagaagcgtccgtcctcgagccaggcgggaggagggagtggagagactgactggccgtgatgggaatgacagtgagaaggtccgcctgtgcgcgtggaacactgtggacgctcgacttccaagggtcttctcacccgtaatgctgcattacatgtaggactgtgtttactaaagtgtgtaaatgtttatataaataccaaattgcagcatccccaaaatgaataaagcctttttacttgtgggtgcaatcgatttttttttctttctcctttctttcaagtgtcgtgagtcgtcttgattgtatattggaaataactgtgtaacaaatcgtattataaatatttcaattaattttactctgaatttgtttattaaaagacttttgaacatgaaatgattagtattacttgaatgcatccagaggatatttaaaccaaaatgaaaaaccagaaggccatttggtgtcccctctcccaggtgtccccttgtagcatatgcattatgtcatctgaattgaggcctttctgtgaacagcatcataacttctatcatggaaagtgtactatatataatgtttgtgtcatgtatatgcctaaattttaatcatctataaataaaacatctgacat

SEQ ID NO: 285438 - DNA, 6589 bp, Homo sapiens
ccacctcccggggtcaagcaattctcatgcctcagctggattatagatattcaccaccatgcctggctaatttctgtatttttagtacagacagggttttgccatgttgcccaggctggtctcgaactcctgggctcaagtgatccgcccgccttggcctcccaaagttctgggattacaggtgtgagctaccatgcccagcctaacaattctgttttttagcaattcactttaagtttttgcaaagttttcagcttagttttcaccataaaaataaaaatatttacttttgcaattgcattttatccctttatgtaatatttaatcaacttacataattatgctgatatgcagttgggaacacatacagtggtacagttgaccaccggtcagcatggtggcaacagaagcaggcaggcaaacgggagggtggtccgcaagcatctgcaatgtgccaggccccagttactgtgtgttatggaggcagtgggcctttggttctgtgaagcagttaacattgagcccaggctagtaagagtcaggactttgtttttcatggaatgaaaacaaaaagaaaactcagctttccctttctttattgcttctatgtcaacctcaagtgtcacctagatttcgtttgctcagtagccacccttgtagtgttaactatgtacctgagtggtctagattagtgtgcgtttttcattatattatttgcagtcatttaaaatttttcgttaaaatgcagagttgttgttatttaaatgcatttgtattttttagggcaagtgtggtcttggggagatggtgactatgggaaattgggcagaggtggtagtgatggctgcaaaaccccaaagctgattgaaaagcttcaagacttggatgtggtcaaagtccgctgtggaagtcagttttccattgctttgacgaaagatggccaagtttattcatggggaaaaggtgacaaccagagacttggacatggaacagaggaacatgttcgttatccaaaactcttagaaggcttgcaagggaagaaggtgattgatgtggctgcaggctccacccactgcctggctctgactgaggacagcgaggtccacagctgggggagcaacgaccagtgccagcactttgacaccttgcgcgtgaccaagccagaacctgcagcattgccaggactggacaccaaacacatagtgggaattgcctgtgggcctgcccagagctttgcttggtcatcatgttctgagtggtccattggcctccgtgtcccttttgtggtggacatctgctcaatgacttttgagcagctagatctcctgcttcggcaggtgagtgaggggatggatggctccgcggactggcccccgccccaggagaaagagtgtgtggccgtggcaacgctgaatcttctacgacttcagttgcatgctgccattagtcaccaggttgacccggaattccttggtttaggtctgggcagcatcctcctgaacagcctgaagcagacggtggtgaccctggccagcagtgcgggcgtgctgagcaccgtgcagtcggccgcccaggccgtgctgcagagtggctggtccgtgctgctgcccaccgcggaggagcgggcccgggcactctctgctctcctgccctgcgcagtttcaggcaatgaagtgaacataagtccaggtcgtcgattcatgattgatcttctggtgggcagcttgatggctgatggagggttggagtcagccttacacgcagccattactgcagagatccaggatattgaagccaaaaaagaagcacagaaggaaaaagaaattgatgaacaggaagcgaatgcctcaacatttcatagaagcaggactccactggataaagaccttattaatacggggatctgtgagtcttctggcaaacagtgtttgcctctggttcagctcatacaacagcttcttagaaacatcgcttctcagactgtagccagattgaaagatgttgcccgtcggatttcatcatgtctggactttgagcaacacagtcgtgaaagatctgcttcattggattggttactgcgtttccaacgtttgcttattagtaaactttatccaggagaaagtattggtcagacctcagatatttctagtccagagctaatgggtgttggttccttgctgaagaagtacacagccctcctgtgcacgcacattggagatatactgcctgtggccgccagcattgcttctaccagctggcggcacttcgcggaggtggcttacattgtggaaggggactttactggtgttctccttccagaactagtagtttctatagtgcttctgctcagtaaaaatgctgatctcatgcaagaggctggagctgtacctctgctgggtggcctgttggaacatctggatcggttcaaccatctggcaccaggaaaggaacgggatgatcatgaagagttagcctggcctggcataatggagtcattttttacaggtcagaactgtagaaataatgaggaagtgacacttatacgcaaagctgatttggagaaccataataaagatggaggcttctggactgtgattgacgggaaggtgtatgatataaaggacttccagacacagtcgttaacaggaaatagtattcttgctcagtttgcaggggaagacccagtggtagctttggaagctgctttgcagtttgaagacacccgggaatccatgcacgcgttttgtgttggccagtatttggagcctgaccaagaaatcgtcaccataccagatctggggagtctctcttcacctctgatagacacagagaggaatctgggcctgcttctcggattacacgcttcgtatttggcaatgagcacaccgctgtctcctgtcgagattgaatgtgccaaatggcttcagtcatccatcttctctggaggcctgcagaccagccagatccactacaggtacaacgaggagaaagacgaggaccactgcagctccccagggggcacacctgccagcaaatctcgactctgctcccacagacgggccctgggggaccattcccaggcatttctgcaagccattgcagacaacaacattcaggatcacaacgtgaaggactttttgtgtcaaatagaaaggtactgtaggcagtgccatttgaccacaccgatcatgtttccccccgagcatcccgtggaagaggtcggtcgcttgttgttatgttgcctcttaaaacatgaagatttaggtcatgtggcattatctttagttcatgcaggtgcacttggtattgagcaagtaaagcacagaacgttgcctaagtcagtggtggatgtttgtagagttgtctaccaagcaaaatgttcgctcattaagactcatcaagaacagggccgttcttacaaggaggtctgcgctcctgtcatcgaacgtttgagattcctctttaatgaattgagacctgctgtttgtaatgacctctctataatgtctaagtttaaattgttaagttctttgccccgttggaggaggatagctcaaaagataattcgagaacgaaggaaaaagagagttcctaagaagccagaatctatggatgatgaagaaaaaattggaaacgaagagagtgatttagaagaagcttgcattttgcctcatagtccaataaatgtggacaagagacccattgcaattaaatcacccaaggacaaatggcagccgctgttgagtactgttacaggtgttcacaaatacaagtggttgaagcagaatgtgcagggtctttatccgcagtctccactcctcagtacaattgctgaatttgcccttaaagaagagccagtggatgtggaaaaaatgagaaagtgcctactaaaacagttggagagagcagaggttcgcctggaagggatagatacaattttaaaactggcgagcaagaatttcttacttccatctgtgcagtatgcgatgttttgtggatggcaaagacttattcctgagggaatcgatataggggaacctcttactgattgtttaaaggatgttgatttgatcccgccttttaatcggatgctgctggaagtcacctttggcaagctgtacgcttgggctgtacagaacattcgaaatgttttgatggatgccagtgccacatttaaagagcttggtatccagccggttcccctccaaaccatcaccaatgagaacccgtcaggaccgagcctggggaccatcccgcaagcccgcttcctcctggtgatgctcagcatgctcaccctgcagcacggcgcaaacaacctcgaccttctgctcaattccggcatgctggccctcacgcagacggcactgcgcctgattggccccagttgtgacaacgttgaggaagatatgaatgcttctgctcaaggtgcttctgccacagttttggaagaaacaaggaaggaaacggctcctgtgcagctccctgtttcaggaccagaactggctgccatgatgaagattggaacaagggtcatgagaggtgtggactggaaatggggcgatcaggatgggcctcctccaggcctaggccgcgtgattggtgagctgggagaggacggatggataagagtccagtgggacacaggcagcaccaactcctacaggatggggaaagaaggaaaatacgacctcaagctggcagagctgccggctgctgcacagccctcagcagaggattcggacacagaggatgactctgaagccgaacaaactgaaaggaacattcaccccactgcaatgatgtttaccagcactattaacttactgcagactctttgtctgtctgctggagttcatgctgagatcatgcagagcgaagccaccaagactttatgcggactgctgcgaatgttagtggaaagcggaacgacggacaagacatcttctccaaacaggctggtgtacagggagcaacaccggagctggtgcacgctggggtttgtgcggagcatcgctctcacgccgcaggtatgcggcgccctcagctccccgcagtggatcacgctgctcatgaaggtcgtggaagggcacgcacccttcactgccacctcgctgcagaggcagatcttagctgtgcatttgttgcaagcagtccttccatcatgggacaagaccgaaagggcgagggacatgaaatgcctcgtggagaagctgtttgacttcttgggaagcttgctcactacctgctcctctgacgtgccattactcagagagtccacgctgaggcggcgcagggtgcgcccgcaggcctcgctgactgccacccacagcagcacactggcggaggaggtggtggcactgctgcgcacgctgcactccctgactcagtggaatgggctcatcaacaagtacatcaactcccagctccgctccatcacccacagctttgtgggaaggccttccgaaggggcccagttagaggactacttccccgactccgagaaccctgaagtggggggcctcatggcagtcctggctgtgattggaggcatcgatggtcgcctgcgcctgggcggtcaagttatgcacgatgagtttggagaaggcactgtgactcgcatcaccccaaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggtgccagcagttgaagctatacatcctgaaagcaggtcgggcgctgctctcccaccaggataaactgcggcagatcctgtctcagccagctgttcaggagactggaactgttcacacagatgatggagcagtggtatcacctgaccttggggacatgtctcctgaagggccgcagccccccatgatcctcttgcagcagctgctggcctcggccacccagccgtctcctgtgaaggccatatttgataaacaggaacttgaggtacagccatgcagccttgacagtttttaatccacagcactaaattttgaacactttttttctagatgtatattttcttaaggatctattctgaatgttaaatgatagtacgcaaataattctaatgattcattggggtttaaccatgtttgtgcatagtctgcagaacattataatactaaagactgagagggttgaagtttaaccttattttgggtttgtgtaaattgtgaaaaaatattaactagatgcagcatgggttaaatgctcacatcttcatgaagggatctttttccaggaagtagaattattcaaagaggctcgtcaggactctggcagccgtttgtttcattcactcaggagcctcttgggggtgctctggtgccgccagcctctccgctctctccatgctgtggagcaggtgagggcagcagcgaggcacagggtcagggctacgggacgtt

SEQ ID NO: 285439 - DNA, 15335 bp, Homo sapiens
ttttcttttctggctttcgggagtgtctttgtaaactattaaaaagcgttaggtcttcagcgtatgtgtttacttgcaggcctgagacctgggaggaagctggagaaaagatgccctctgaatctttctgtttggctgcccaggctcgcctcgactccaaatggttgaaaacagatatacagcttgcattcacaagagatgggctctgtggtctgtggaatgaaatggttaaagatggagaaattgtatacactggaacagaatcaacccagaacggagagctccctcctagaaaagatgatagtgtcgaaccaagtggaacaaagaaagaagatctgaatgacaaagagaaaaaagatgaagaagaaactcctgcacctatatatagggccaagtcaattctggacagctgggtatggggcaagcaaccagatgtgaatgaactgaaggagtgtctttctgtgctggttaaagagcagcaggccctggccgtccagtcagccaccaccaccctctcagccctgcgactcaagcagaggctggtgatcttggagcgctatttcattgccttgaatagaaccgtttttcaggagaatgtcaaagttaagtggaaaagcagcggtatttctctgcctcctgtggacaaaaaaagttcccggcctgcgggcaaaggtgtggaggggctcgccagagtgggatcccgagcggcgctgtcttttgcctttgccttcctgcgcagggcctggcgatcaggcgaggatgcggacctctgcagtgagctgttgcaggagtccctggacgccctgcgagcacttcccgaggcctcgctctttgacgagagcaccgtgtcctctgtgtggctggaggtggtggagagagcgaccaggttcctcaggtccgtcgtgacgggggatgttcacggaacgccagccaccaaagggccaggaagcatccccctgcaggaccagcacttggccctggccatcctgctggagctggctgtgcagagaggcacgctgagccaaatgttgtctgccatcctgttgttgcttcagctgtgggacagcggggcacaggagactgacaatgagcgttccgcccagggcaccagcgccccacttttgcccttgctgcaaaggttccagagcatcatttgcaggaaggatgcaccccactccgagggcgacatgcaccttttgtctggccctctgagccccaatgagagtttcctgaggtacctcacccttccacaagacaacgagcttgccattgatctgcgacaaacggcggttgttgtcatggcccatttagaccgtctggctacgccctgtatgcctccgctgtgtagctctccgacatctcataagggatcattgcaagaggtcataggttgggggttaataggatggaaatactatgccaatgtgattggtccaatccagtgcgaaggcctggccaacctgggagtcacacagattgcctgtgcagagaagcgtttcctgattctgtcacgcaatggccgcgtgtacacacaggcctataatagtgacacgctggccccacagctggtccaaggccttgcctccagaaacattgtaaaaattgctgcccattctgatggtcaccactacctagccttggctgctactggagaggtgtactcctggggctgtggggacggcggacggctgggccatggggacactgtgcctttggaggagcctaaggtgatctccgccttctctggaaagcaggccgggaagcacgtggtgcacatcgcttgcgggagcacttacagtgcggccatcactgccgagggggagctgtacacctggggccgcgggaactacggccggctgggccatggctccagtgaggacgaggccattccgatgctggtagccgggcttaaaggactgaaggtcatcgatgtggcgtgtgggagtggggatgctcaaaccctggctgtcactgagaacgggcaagtgtggtcttggggagatggtgactatgggaaattgggcagaggtggtagtgatggctgcaaaaccccaaagctgattgaaaagcttcaagacttggatgtggtcaaagtccgctgtggaagtcagttttccattgctttgacgaaagatggccaagtttattcatggggaaaaggtgacaaccagagacttggacatggaacagaggaacatgttcgttatccaaaactcttagaaggcttgcaagggaagaaggtgattgatgtggctgcaggctccacccactgcctggctctgactgaggacagcgaggtccacagctgggggagcaacgaccagtgccagcactttgacaccttgcgcgtgaccaagccagaacctgcagcattgccaggactggacaccaaacacatagtgggaattgcctgtgggcctgcccagagctttgcttggtcatcatgttctgagtggtccattggcctccgtgtcccttttgtggtggacatctgctcaatgacttttgagcagctagatctcctgcttcggcaggtgagtgaggggatggatggctccgcggactggcccccgccccaggagaaagagtgtgtggccgtggcaacgctgaatcttctacgacttcagttgcatgctgccattagtcaccaggttgacccggaattccttggtttaggtctgggcagcatcctcctgaacagcctgaagcagacggtggtgaccctggccagcagtgcgggcgtgctgagcaccgtgcagtcggccgcccaggccgtgctgcagagtggctggtccgtgctgctgcccaccgcggaggagcgggcccgggcactctctgctctcctgccctgcgcagtttcaggcaatgaagtgaacataagtccaggtcgtcgattcatgattgatcttctggtgggcagcttgatggctgatggagggttggagtcagccttacacgcagccattactgcagagatccaggatattgaagccaaaaaagaagcacagaaggaaaaagaaattgatgaacaggaagcgaatgcctcaacatttcatagaagcaggactccactggataaagaccttattaatacggggatctgtgagtcttctggcaaacagtgtttgcctctggttcagctcatacaacagcttcttagaaacatcgcttctcagactgtagccagattgaaagatgttgcccgtcggatttcatcatgtctggactttgagcaacacagtcgtgaaagatctgcttcattggattggttactgcgtttccaacgtttgcttattagtaaactttatccaggagaaagtattggtcagacctcagatatttctagtccagagctaatgggtgttggttccttgctgaagaagtacacagccctcctgtgcacgcacattggagatatactgcctgtggccgccagcattgcttctaccagctggcggcacttcgcggaggtggcttacattgtggaaggggactttactggtgttctccttccagaactagtagtttctatagtgcttctgctcagtaaaaatgctgatctcatgcaagaggctggagctgtacctctgctgggtggcctgttggaacatctggatcggttcaaccatctggcaccaggaaaggaacgggatgatcatgaagagttagcctggcctggcataatggagtcattttttacaggtcagaactgtagaaataatgaggaagtgacacttatacgcaaagctgatttggagaaccataataaagatggaggcttctggactgtgattgacgggaaggtgtatgatataaaggacttccagacacagtcgttaacaggaaatagtattcttgctcagtttgcaggggaagacccagtggtagctttggaagctgctttgcagtttgaagacacccgggaatccatgcacgcgttttgtgttggccagtatttggagcctgaccaagaaatcgtcaccataccagatctggggagtctctcttcacctctgatagacacagagaggaatctgggcctgcttctcggattacacgcttcgtatttggcaatgagcacaccgctgtctcctgtcgagattgaatgtgccaaatggcttcagtcatccatcttctctggaggcctgcagaccagccagatccactacaggtacaacgaggagaaagacgaggaccactgcagctccccagggggcacacctgccagcaaatctcgactctgctcccacagacgggccctgggggaccattcccaggcatttctgcaagccattgcagacaacaacattcaggatcacaacgtgaaggactttttgtgtcaaatagaaaggtactgtaggcagtgccatttgaccacaccgatcatgtttccccccgagcatcccgtggaagaggtcggtcgcttgttgttatgttgcctcttaaaacatgaagatttaggtcatgtggcattatctttagttcatgcaggtgcacttggtattgagcaagtaaagcacagaacgttgcctaagtcagtggtggatgtttgtagagttgtctaccaagcaaaatgttcgctcattaagactcatcaagaacagggccgttcttacaaggaggtctgcgctcctgtcatcgaacgtttgagattcctctttaatgaattgagacctgctgtttgtaatgacctctctataatgtctaagtttaaattgttaagttctttgccccgttggaggaggatagctcaaaagataattcgagaacgaaggaaaaagagagttcctaagaagccagaatctatggatgatgaagaaaaaattggaaacgaagagagtgatttagaagaagcttgcattttgcctcatagtccaataaatgtggacaagagacccattgcaattaaatcacccaaggacaaatggcagccgctgttgagtactgttacaggtgttcacaaatacaagtggttgaagcagaatgtgcagggtctttatccgcagtctccactcctcagtacaattgctgaatttgcccttaaagaagagccagtggatgtggaaaaaatgagaaagtgcctactaaaacagttggagagagcagaggttcgcctggaagggatagatacaattttaaaactggcgagcaagaatttcttacttccatctgtgcagtatgcgatgttttgtggatggcaaagacttattcctgagggaatcgatataggggaacctcttactgattgtttaaaggatgttgatttgatcccgccttttaatcggatgctgctggaagtcacctttggcaagctgtacgcttgggctgtacagaacattcgaaatgttttgatggatgccagtgccacatttaaagagcttggtatccagccggttcccctccaaaccatcaccaatgagaacccgtcaggaccgagcctggggaccatcccgcaagcccgcttcctcctggtgatgctcagcatgctcaccctgcagcacggcgcaaacaacctcgaccttctgctcaattccggcatgctggccctcacgcagacggcactgcgcctgattggccccagttgtgacaacgttgaggaagatatgaatgcttctgctcaaggtgcttctgccacagttttggaagaaacaaggaaggaaacggctcctgtgcagctccctgtttcaggaccagaactggctgccatgatgaagattggaacaagggtcatgagaggtgtggactggaaatggggcgatcaggatgggcctcctccaggcctaggccgcgtgattggtgagctgggagaggacggatggataagagtccagtgggacacaggcagcaccaactcctacaggatggggaaagaaggaaaatacgacctcaagctggcagagctgccggctgctgcacagccctcagcagaggattcggacacagaggatgactctgaagccgaacaaactgaaaggaacattcaccccactgcaatgatgtttaccagcactattaacttactgcagactctttgtctgtctgctggagttcatgctgagatcatgcagagcgaagccaccaagactttatgcggactgctgcgaatgttagtggaaagcggaacgacggacaagacatcttctccaaacaggctggtgtacagggagcaacaccggagctggtgcacgctggggtttgtgcggagcatcgctctcacgccgcaggtatgcggcgccctcagctccccgcagtggatcacgctgctcatgaaggtcgtggaagggcacgcacccttcactgccacctcgctgcagaggcagatcttagctgtgcatttgttgcaagcagtccttccatcatgggacaagaccgaaagggcgagggacatgaaatgcctcgtggagaagctgtttgacttcttgggaagcttgctcactacctgctcctctgacgtgccattactcagagagtccacgctgaggcggcgcagggtgcgcccgcaggcctcgctgactgccacccacagcagcacactggcggaggaggtggtggcactgctgcgcacgctgcactccctgactcagtggaatgggctcatcaacaagtacatcaactcccagctccgctccatcacccacagctttgtgggaaggccttccgaaggggcccagttagaggactacttccccgactccgagaaccctgaagtggggggcctcatggcagtcctggctgtgattggaggcatcgatggtcgcctgcgcctgggcggtcaagttatgcacgatgagtttggagaaggcactgtgactcgcatcaccccaaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggtgccagcagttgaagctatacatcctgaaagcaggtcgggcgctgctctcccaccaggataaactgcggcagatcctgtctcagccagctgttcaggagactggaactgttcacacagatgatggagcagtggtatcacctgaccttggggacatgtctcctgaagggccgcagccccccatgatcctcttgcagcagctgctggcctcggccacccagccgtctcctgtgaaggccatatttgataaacaggaacttgaggctgctgcactggccgtttgccagtgcttggctgtggagtccactcacccttcgagcccaggatttgaagactgcagctccagtgaggccaccacgcctgtcgccgtgcagcacatccgccctgccagagtgaagaggcgcaagcagtcgcccgttcccgctctgccgatcgtggtgcagctcatggagatgggattttccagaaggaacatcgagtttgccctgaagtctctcactggtgcttccgggaatgcatccagcttgcctggtgtggaagccttggtcgggtggctgctggaccactccgacatacaggtcacggagctctcagatgcagacacggtgtccgacgagtattctgacgaggaggtggtggaggacgtggatgatgccgcctactccatgtctactggtgctgttgtgacggagagccagacgtacaaaaaacgagctgatttcttgagtaatgatgattatgctgtatatgtgagagagaatattcaggtgggaatgatggttagatgctgccgagcgtatgaagaagtgtgcgaaggtgatgttggcaaagtcatcaagctggacagagatggattgcatgatctcaatgtgcagtgtgactggcagcagaaagggggcacctactgggttaggtacattcatgtggaacttataggctatcctccaccaagttcttcttctcacatcaagattggtgataaagtgcgggtcaaagcctctgtcaccacaccaaaatacaaatggggatctgtgactcatcagagtgtgggggttgtgaaagctttcagtgccaatggaaaagatatcattgtcgactttccccagcagtctcactggactgggttgctatcagaaatggagttggtacccagtattcatcctggggttacgtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggtcagtctgcggtattttgtggccgttctggaaaacagctgaagcgttgccacagcagccagccaggcatgctgctggacagctggtcccgcatggtgaagagcctgaatgtgtcgtcctccgtgaaccaggcatcccgtctcattgacggcagcgagccctgctggcagtcatcggggtcgcaaggaaagcactggattcgtttggagattttcccagatgttcttgttcatagattaaaaatgatcgtagatcctgctgacagtagctacatgccgtccctggttgtagtgtcaggtggaaattccctgaataaccttattgaactaaagacaatcaatattaacccttctgacaccacagtgccccttctgaatgactacacagagtatcacaggtatattgaaattgctataaagcagtgcaggagctcaggaatcgattgtaaaatccatggtctcatcctgctgggacggatccgtgcagaagaggaagatttggctgcagttcctttcttagcttcggataatgaagaggaggaggatgagaaaggcaacagcggaagcctcattagaaagaaggctgctgggctggaatcagcagctacgataagaaccaaggtgtttgtgtggggcctgaatgacaaggaccagctgggcgggctgaaaggctccaagataaaggttccttcgttctctgagacactgtcagctttgaatgtggtacaggtggctggtggatctaaaagtttgtttgcagtgactgtggaagggaaggtgtatgcctgtggagaagccacgaatggccggctggggctgggcatttccagcgggacggtgcccatcccacggcagatcacagctctcagcagctacgtggtcaagaaggtggctgttcactcaggtggccggcacgcgacggctttaactgtcgatggaaaagtgttttcgtggggcgaaggtgacgatggaaaacttggacacttcagcagaatgaactgtgacaaaccaaggctgatcgaggccctgaaaaccaagcgtatccgggatatcgcctgtgggagctcgcacagcgcagccctcacatccagcggagaactgtacacctggggcctcggcgagtacggccggctgggacatggggataatacgacacagctaaagcccaaaatggtgaaagtccttctcggtcacagagtaatccaggttgcatgtgggagtagagacgcgcagaccctggctctgaccgatgaaggtttggtattttcctggggtgatggtgactttggaaaactgggccggggcggaagtgaaggctgtaacattccccagaacattgagagactaaatggacagggggtgtgccagattgagtgtggagctcagttctccctggcgctcaccaagtctggagtggtgtggacatggggaaagggggattacttcagattgggccacggctctgacgtgcacgtgcggaaaccacaggtggtggaagggctgagagggaagaagatcgtgcatgtggctgtcggggccctgcactgcctggcggtcacggactcggggcaggtgtatgcttggggtgacaacgaccacggccagcagggcaatggcacgaccacggttaacaggaagcccacactcgtgcaaggcttagaaggccagaagatcacacgcgtggcttgtgggtcgtcccacagtgtggcgtggacaactgtggatgtggccacgccctctgtccacgagcccgtcctcttccagactgcaagagacccgttaggtgcttcctacttaggcgtgccctcagatgctgattcttctgctgccagtaataaaataagtggtgcaagtaattctaagccaaatcgcccttctcttgccaagattctcttgtcattggatggaaatctggccaaacagcaggccttatcgcatattcttacagcattgcaaatcatgtatgccagagatgctgttgtcggggccctgatgccggccgccatgatcgccccggtggagtgcccctcgttctcctcggcggccccttccgacgcatctgcgatggctagtcccatgaatggagaagaatgcatgctggctgttgatatcgaagacagactgagtccaaatccatggcaagaaaagagagagattgtttcctctgaggacgcagtgaccccctctgcagtgactccgtcggccccctcagcctccgctcggccttttatcccagtgacggatgacctgggagctgcaagcatcattgcagaaaccatgaccaaaaccaaagaggatgttgaaagccaaaataaagcagcaggtccggagcctcaggccttggatgagttcaccagtctgctgattgcggatgacactcgtgtggtggtagacctgctcaagctgtcagtgtgcagccgggccggggacaggggcagggatgtgctctccgcggtgctttccggcatggggaccgcctacccacaggtggcagatatgctgttggagctctgtgtcaccgagttggaggatgtggccacagactcgcagagcggccgcctctcttctcagcctgtggtggtggagagtagccacccttacaccgacgacacctccaccagtggcacagtgaagataccaggtgcagaaggactcagggtagaatttgaccggcagtgctccacagagaggcgccacgaccctctcacagtcatggacggcgtcaacaggatcgtctccgtgcggtcaggccgagagtggtccgactggtccagcgagctgcgcatcccaggggatgagttaaagtggaagttcatcagcgatgggtctgtgaatggctggggctggcgcttcaccgtctatcccatcatgccagctgctggccctaaagaactcctctctgaccgctgcgtcctctcctgtccatccatggacttggtgacgtgtctgttagacttccgactcaaccttgcctctaacagaagcatcgtccctcgccttgcggcctcgctggcagcttgtgcacagctgagtgccctagctgccagtcacagaatgtgggcccttcagagactgaggaagctgcttacaactgaatttgggcagtcaattaacataaataggctgcttggagaaaatgatggggaaacaagagctttgagttttacaggtagtgctcttgctgctttggtgaaaggtcttccagaagctttgcaaaggcagtttgaatatgaagatcctattgtgaggggtggcaaacagctgctccacagcccattctttaaggtactagtagctcttgcttgtgacctggagctggacactctgccttgctgtgccgagacgcacaagtgggcctggttccggaggtactgcatggcctcccgtgttgctgtggcccttgacaaaagaacaccgttgccccgtctgtttcttgatgaggtggctaagaaaattcgtgaattaatggcagacagcgaaaacatggatgttctgcatgagagccatgacatttttaaaagagagcaagacgaacaacttgtgcagtggatgaacaggcgaccagatgactggactctctctgctggtggcagtggaacaatttatggatggggacataatcacaggggccagctcgggggcattgaaggcgcaaaagtcaaagttcccactccctgtgaagcccttgcaactctcagacccgtgcagttaatcggaggggaacagaccctctttgctgtgacggctgatgggaagctgtatgccactgggtatggtgcaggtggcagactaggcattggagggacagagtcggtgtccaccccaacattgcttgaatccattcagcatgtgtttattaagaaagtagctgtgaactctggaggaaagcactgccttgccctgtcttcagaaggagaagtttactcttggggtgaggcagaagatgggaagttggggcatggcaacagaagtccgtgtgaccgccctcgtgtcatcgagtctctgagaggaattgaagtggtcgatgttgctgctggcggagcccacagcgcctgtgtcacagcagccggggacctctacacatggggcaaaggccgctacggccggctggggcacagcgacagtgaggaccagctgaagccgaagctggtggaggcgctgcagggccaccgtgtggttgacatcgcctgtggcagtggagatgcccagaccctctgcctcacagatgacgacactgtctggtcctggggggacggggactacggcaagctcggccggggaggcagcgatggctgtaaagtgcctatgaagattgattctcttactggtcttggagtagttaaagtggaatgcggatcccagttttctgttgcccttaccaaatctggagctgtttatacctggggcaaaggcgattatcacaggttgggccatggatcagatgaccatgttcgaaggcctcggcaggtccaagggttgcaggggaagaaagtcatcgccatcgccactggctccctgcactgtgtgtgctgcacagaggatggtgaggtttatacatggggcgacaatgatgagggacaactgggagacggaaccaccaatgccatccagaggcctcggttggtagctgcccttcagggtaagaaggtcaaccgtgtggcctgtggctcagcacataccctcgcctggtcgaccagcaagcccgccagtgctggcaaactccctgcacaggtccccatggagtacaatcacctgcaggagatccccatcattgcgctgaggaaccgtctgctgctgctgcaccacctctccgagctcttctgcccctgcatccccatgttcgacctggaaggctcgctcgacgaaactggactcgggccttctgttgggttcgacactctccgaggaattctgatatcccagggaaaggaggcggctttccggaaagtagtacaagcaactatggtacgcgatcgtcagcatggccccgtcgtggagctgaaccgcatccaggtcaaacgatcaaggagcaaaggcgggctggccggccccgacggcaccaagtctgtctttgggcagatgtgtgctaagatgagctcgtttggtcccgacagcctcctccttcctcaccgtgtctggaaagtcaagtttgtgggtgaatctgtggatgactgtgggggcggctacagcgagtccatagctgagatctgtgaggagctgcagaacggactcacgcccctgctgatcgtgacacccaacgggagggatgagtctggggccaaccgagactgctacctgctcagcccggccgccagagcacccgtgcacagcagcatgttccgcttcctgggtgtgttgctgggcattgccatccgaaccgggagtcccctgagcctcaaccttgccgagcctgtctggaagcagctggctgggatgagcctcaccatcgcggacctcagtgaggttgataaggattttattcctggactcatgtacatccgagacaatgaagccacctcagaggagtttgaagccatgagcctgcccttcacagtgccaagtgccagtggccaggacattcagttgagctccaagcacacacacatcaccctggacaaccgcgcggagtacgtgcggctggcgataaactatagactccatgaatttgatgagcaggtggctgctgttcgggaaggaatggcccgcgttgtgcctgttcccctcctctctctgttcaccggctacgaactggagacgatggtgtgtggcagccctgacatcccgctgcaccttctcaagtcggtggccacctataaaggcatcgagccttccgcatcgctgatccagtggttctgggaggtgatggagtccttctccaacacagagcgctctcttttccttcgcttcgtctggggccggacgaggctgcccaggaccatcgccgacttccggggccgagacttcgtcatccaggtgttggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagccagccgccgacgacagcagcgacgattcagataacgaggatgtcgactcctttgcttcggactctacacaagattatttaacaggacactaagatggggaaacgtcctcgtgagatgagagcctgagccaggcagcagagcactcgctgctgtgtagactgtaggctgcctggtgtgtctgatgagaagcgtccgtcctcgagccaggcgggaggagggagtggagagactgactggccgtgatgggaatgacagtgagaaggtccgcctgtgcgcgtggaacactgtggacgctcgacttccaagggtcttctcacccgtaatgctgcattacatgtaggactgtgtttactaaagtgtgtaaatgtttatataaataccaaattgcagcatccccaaaatgaataaagcctttttacttgtgggtgcaatcgatttttttttctttctcctttctttcaagtgtcgtgagtcgtcttgattgtatattggaaataactgtgtaacaaatcgtattataaatatttcaattaattttactctgaatttgtttattaaaagacttttgaacatgaaatgattagtattacttgaatgcatccagaggatatttaaaccaaaatgaaaaaccagaaggccatttggtgtcccctctcccaggtgtccccttgtagcatatgcattatgtcatctgaattgaggcctttctgtgaacagcatcataacttctatcatggaaagtgtactatatataatgtttgtgtcatgtatatgcctaaattttaatcatctataaataaaacatctgacat

SEQ ID NO: 285440 - DNA, 8937 bp, Homo sapiens
tctggatctcccattcacatgtctggttggaggtgcagtgcatgcaaatcaccacatgtccgaaattcagctggctttctctagtagctgccgtttcccatcgtggtgaataaacctgtctgccagttagttgagccagtgtccgagcggcacctgcggccctccttccttcccaccccatgctctctgtgctgcttctgcggcctctgctatcagataagccttgggcattgctgccatcttcatcagttaaagagctagtggggctgacagattctctcagaggagtcttagaagaagagtgaaagcggctgaaacttcagcaacttggggaacatttgatcatattaatagtagctaacatggttctaaccgtgttaaacccattgaatcctgcgtcctatcaagttaggtgcctggagagcagggaaggaagacccaggaggcagaagatgcttacccagaagcaccgagtgtaactctgggaaaggcaagcccttcgtcacggacagtgtgtgcggtcggcagattcctgaagggcagagcgttactcgtcgccatgtggcggaggcttgctgctggcgaggagggagtctgagcagggcacgcccttctcactgagtctttccttccgcaggacaagtggacctggacctgctgcggtgccagcagttgaagctatacatcctgaaagcaggtcgggcgctgctctcccaccaggataaactgcggcagatcctgtctcagccagctgttcaggagactggaactgttcacacagatgatggagcagtggtatcacctgaccttggggacatgtctcctgaagggccgcagccccccatgatcctcttgcagcagctgctggcctcggccacccagccgtctcctgtgaaggccatatttgataaacaggaacttgaggctgctgcactggccgtttgccagtgcttggctgtggagtccactcacccttcgagcccaggatttgaagactgcagctccagtgaggccaccacgcctgtcgccgtgcagcacatccgccctgccagagtgaagaggcgcaagcagtcgcccgttcccgctctgccgatcgtggtgcagctcatggagatgggattttccagaaggaacatcgagtttgccctgaagtctctcactggtgcttccgggaatgcatccagcttgcctggtgtggaagccttggtcgggtggctgctggaccactccgacatacaggtcacggagctctcagatgcagacacggtgtccgacgagtattctgacgaggaggtggtggaggacgtggatgatgccgcctactccatgtctactggtgctgttgtgacggagagccagacgtacaaaaaacgagctgatttcttgagtaatgatgattatgctgtatatgtgagagagaatattcaggtgggaatgatggttagatgctgccgagcgtatgaagaagtgtgcgaaggtgatgttggcaaagtcatcaagctggacagagatggattgcatgatctcaatgtgcagtgtgactggcagcagaaagggggcacctactgggttaggtacattcatgtggaacttataggctatcctccaccaagttcttcttctcacatcaagattggtgataaagtgcgggtcaaagcctctgtcaccacaccaaaatacaaatggggatctgtgactcatcagagtgtgggggttgtgaaagctttcagtgccaatggaaaagatatcattgtcgactttccccagcagtctcactggactgggttgctatcagaaatggagttggtacccagtattcatcctggggttacgtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggtcagtctgcggtattttgtggccgttctggaaaacagctgaagcgttgccacagcagccagccaggcatgctgctggacagctggtcccgcatggtgaagagcctgaatgtgtcgtcctccgtgaaccaggcatcccgtctcattgacggcagcgagccctgctggcagtcatcggggtcgcaaggaaagcactggattcgtttggagattttcccagatgttcttgttcatagattaaaaatgatcgtagatcctgctgacagtagctacatgccgtccctggttgtagtgtcaggtggaaattccctgaataaccttattgaactaaagacaatcaatattaacccttctgacaccacagtgccccttctgaatgactacacagagtatcacaggtatattgaaattgctataaagcagtgcaggagctcaggaatcgattgtaaaatccatggtctcatcctgctgggacggatccgtgcagaagaggaagatttggctgcagttcctttcttagcttcggataatgaagaggaggaggatgagaaaggcaacagcggaagcctcattagaaagaaggctgctgggctggaatcagcagctacgataagaaccaaggtgtttgtgtggggcctgaatgacaaggaccagctgggcgggctgaaaggctccaagataaaggttccttcgttctctgagacactgtcagctttgaatgtggtacaggtggctggtggatctaaaagtttgtttgcagtgactgtggaagggaaggtgtatgcctgtggagaagccacgaatggccggctggggctgggcatttccagcgggacggtgcccatcccacggcagatcacagctctcagcagctacgtggtcaagaaggtggctgttcactcaggtggccggcacgcgacggctttaactgtcgatggaaaagtgttttcgtggggcgaaggtgacgatggaaaacttggacacttcagcagaatgaactgtgacaaaccaaggctgatcgaggccctgaaaaccaagcgtatccgggatatcgcctgtgggagctcgcacagcgcagccctcacatccagcggagaactgtacacctggggcctcggcgagtacggccggctgggacatggggataatacgacacagctaaagcccaaaatggtgaaagtccttctcggtcacagagtaatccaggttgcatgtgggagtagagacgcgcagaccctggctctgaccgatgaaggtttggtattttcctggggtgatggtgactttggaaaactgggccggggcggaagtgaaggctgtaacattccccagaacattgagagactaaatggacagggggtgtgccagattgagtgtggagctcagttctccctggcgctcaccaagtctggagtggtgtggacatggggaaagggggattacttcagattgggccacggctctgacgtgcacgtgcggaaaccacaggtggtggaagggctgagagggaagaagatcgtgcatgtggctgtcggggccctgcactgcctggcggtcacggactcggggcaggtgtatgcttggggtgacaacgaccacggccagcagggcaatggcacgaccacggttaacaggaagcccacactcgtgcaaggcttagaaggccagaagatcacacgcgtggcttgtgggtcgtcccacagtgtggcgtggacaactgtggatgtggccacgccctctgtccacgagcccgtcctcttccagactgcaagagacccgttaggtgcttcctacttaggcgtgccctcagatgctgattcttctgctgccagtaataaaataagtggtgcaagtaattctaagccaaatcgcccttctcttgccaagattctcttgtcattggatggaaatctggccaaacagcaggccttatcgcatattcttacagcattgcaaatcatgtatgccagagatgctgttgtcggggccctgatgccggccgccatgatcgccccggtggagtgcccctcgttctcctcggcggccccttccgacgcatctgcgatggctagtcccatgaatggagaagaatgcatgctggctgttgatatcgaagacagactgagtccaaatccatggcaagaaaagagagagattgtttcctctgaggacgcagtgaccccctctgcagtgactccgtcggccccctcagcctccgctcggccttttatcccagtgacggatgacctgggagctgcaagcatcattgcagaaaccatgaccaaaaccaaagaggatgttgaaagccaaaataaagcagcaggtccggagcctcaggccttggatgagttcaccagtctgctgattgcggatgacactcgtgtggtggtagacctgctcaagctgtcagtgtgcagccgggccggggacaggggcagggatgtgctctccgcggtgctttccggcatggggaccgcctacccacaggtggcagatatgctgttggagctctgtgtcaccgagttggaggatgtggccacagactcgcagagcggccgcctctcttctcagcctgtggtggtggagagtagccacccttacaccgacgacacctccaccagtggcacagtgaagataccaggtgcagaaggactcagggtagaatttgaccggcagtgctccacagagaggcgccacgaccctctcacagtcatggacggcgtcaacaggatcgtctccgtgcggtcaggccgagagtggtccgactggtccagcgagctgcgcatcccaggggatgagttaaagtggaagttcatcagcgatgggtctgtgaatggctggggctggcgcttcaccgtctatcccatcatgccagctgctggccctaaagaactcctctctgaccgctgcgtcctctcctgtccatccatggacttggtgacgtgtctgttagacttccgactcaaccttgcctctaacagaagcatcgtccctcgccttgcggcctcgctggcagcttgtgcacagctgagtgccctagctgccagtcacagaatgtgggcccttcagagactgaggaagctgcttacaactgaatttgggcagtcaattaacataaataggctgcttggagaaaatgatggggaaacaagagctttgagttttacaggtagtgctcttgctgctttggtgaaaggtcttccagaagctttgcaaaggcagtttgaatatgaagatcctattgtgaggggtggcaaacagctgctccacagcccattctttaaggtactagtagctcttgcttgtgacctggagctggacactctgccttgctgtgccgagacgcacaagtgggcctggttccggaggtactgcatggcctcccgtgttgctgtggcccttgacaaaagaacaccgttgccccgtctgtttcttgatgaggtggctaagaaaattcgtgaattaatggcagacagcgaaaacatggatgttctgcatgagagccatgacatttttaaaagagagcaagacgaacaacttgtgcagtggatgaacaggcgaccagatgactggactctctctgctggtggcagtggaacaatttatggatggggacataatcacaggggccagctcgggggcattgaaggcgcaaaagtcaaagttcccactccctgtgaagcccttgcaactctcagacccgtgcagttaatcggaggggaacagaccctctttgctgtgacggctgatgggaagctgtatgccactgggtatggtgcaggtggcagactaggcattggagggacagagtcggtgtccaccccaacattgcttgaatccattcagcatgtgtttattaagaaagtagctgtgaactctggaggaaagcactgccttgccctgtcttcagaaggagaagtttactcttggggtgaggcagaagatgggaagttggggcatggcaacagaagtccgtgtgaccgccctcgtgtcatcgagtctctgagaggaattgaagtggtcgatgttgctgctggcggagcccacagcgcctgtgtcacagcagccggggacctctacacatggggcaaaggccgctacggccggctggggcacagcgacagtgaggaccagctgaagccgaagctggtggaggcgctgcagggccaccgtgtggttgacatcgcctgtggcagtggagatgcccagaccctctgcctcacagatgacgacactgtctggtcctggggggacggggactacggcaagctcggccggggaggcagcgatggctgtaaagtgcctatgaagattgattctcttactggtcttggagtagttaaagtggaatgcggatcccagttttctgttgcccttaccaaatctggagctgtttatacctggggcaaaggcgattatcacaggttgggccatggatcagatgaccatgttcgaaggcctcggcaggtccaagggttgcaggggaagaaagtcatcgccatcgccactggctccctgcactgtgtgtgctgcacagaggatggtgaggtttatacatggggcgacaatgatgagggacaactgggagacggaaccaccaatgccatccagaggcctcggttggtagctgcccttcagggtaagaaggtcaaccgtgtggcctgtggctcagcacataccctcgcctggtcgaccagcaagcccgccagtgctggcaaactccctgcacaggtccccatggagtacaatcacctgcaggagatccccatcattgcgctgaggaaccgtctgctgctgctgcaccacctctccgagctcttctgcccctgcatccccatgttcgacctggaaggctcgctcgacgaaactggactcgggccttctgttgggttcgacactctccgaggaattctgatatcccagggaaaggaggcggctttccggaaagtagtacaagcaactatggtacgcgatcgtcagcatggccccgtcgtggagctgaaccgcatccaggtcaaacgatcaaggagcaaaggcgggctggccggccccgacggcaccaagtctgtctttgggcagatgtgtgctaagatgagctcgtttggtcccgacagcctcctccttcctcaccgtgtctggaaagtcaagtttgtgggtgaatctgtggatgactgtgggggcggctacagcgagtccatagctgagatctgtgaggagctgcagaacggactcacgcccctgctgatcgtgacacccaacgggagggatgagtctggggccaaccgagactgctacctgctcagcccggccgccagagcacccgtgcacagcagcatgttccgcttcctgggtgtgttgctgggcattgccatccgaaccgggagtcccctgagcctcaaccttgccgagcctgtctggaagcagctggctgggatgagcctcaccatcgcggacctcagtgaggttgataaggattttattcctggactcatgtacatccgagacaatgaagccacctcagaggagtttgaagccatgagcctgcccttcacagtgccaagtgccagtggccaggacattcagttgagctccaagcacacacacatcaccctggacaaccgcgcggagtacgtgcggctggcgataaactatagactccatgaatttgatgagcaggtggctgctgttcgggaaggaatggcccgcgttgtgcctgttcccctcctctctctgttcaccggctacgaactggagacgatggtgtgtggcagccctgacatcccgctgcaccttctcaagtcggtggccacctataaaggcatcgagccttccgcatcgctgatccagtggttctgggaggtgatggagtccttctccaacacagagcgctctcttttccttcgcttcgtctggggccggacgaggctgcccaggaccatcgccgacttccggggccgagacttcgtcatccaggtgttggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagccagccgccgacgacagcagcgacgattcagataacgaggatgtcgactcctttgcttcggactctacacaagattatttaacaggacactaagatggggaaacgtcctcgtgagatgagagcctgagccaggcagcagagcactcgctgctgtgtagactgtaggctgcctggtgtgtctgatgagaagcgtccgtcctcgagccaggcgggaggagggagtggagagactgactggccgtgatgggaatgacagtgagaaggtccgcctgtgcgcgtggaacactgtggacgctcgacttccaagggtcttctcacccgtaatgctgcattacatgtaggactgtgtttactaaagtgtgtaaatgtttatataaataccaaattgcagcatccccaaaatgaataaagcctttttacttgtgggtgcaatcgatttttttttctttctcctttctttcaagtgtcgtgagtcgtcttgattgtatattggaaataactgtgtaacaaatcgtattataaatatttcaattaattttactctgaatttgtttattaaaagacttttgaacatgaaatgattagtattacttgaatgcatccagaggatatttaaaccaaaatgaaaaaccagaaggccatttggtgtcccctctcccaggtgtccccttgtagcatatgcattatgtcatctgaattgaggcctttctgtgaacagcatcataacttctatcatggaaagtgtactatatataatgtttgtgtcatgtatatgcctaaattttaatcatctataaataaaacatctgacat

SEQ ID NO: 285441 - DNA, 10924 bp, Homo sapiens
acctgaggtacatattcatccctgcccttcttttaaatgtctttttacaggtcatgtggcattatctttagttcatgcaggtgcacttggtattgagcaagtaaagcacagaacgttgcctaagtcagtggtggatgtttgtagagttgtctaccaagcaaaatgttcgctcattaagactcatcaagaacagggccgttcttacaaggaggtctgcgctcctgtcatcgaacgtttgagattcctctttaatgaattgagacctgctgtttgtaatgacctctctataatgtctaagtttaaattgttaagttctttgccccgttggaggaggatagctcaaaagataattcgagaacgaaggaaaaagagagttcctaagaagccagaatctatggatgatgaagaaaaaattggaaacgaagagagtgatttagaagaagcttgcattttgcctcatagtccaataaatgtggacaagagacccattgcaattaaatcacccaaggacaaatggcagccgctgttgagtactgttacaggtgttcacaaatacaagtggttgaagcagaatgtgcagggtctttatccgcagtctccactcctcagtacaattgctgaatttgcccttaaagaagagccagtggatgtggaaaaaatgagaaagtgcctactaaaacagttggagagagcagaggttcgcctggaagggatagatacaattttaaaactggcgagcaagaatttcttacttccatctgtgcagtatgcgatgttttgtggatggcaaagacttattcctgagggaatcgatataggggaacctcttactgattgtttaaaggatgttgatttgatcccgccttttaatcggatgctgctggaagtcacctttggcaagctgtacgcttgggctgtacagaacattcgaaatgttttgatggatgccagtgccacatttaaagagcttggtatccagccggttcccctccaaaccatcaccaatgagaacccgtcaggaccgagcctggggaccatcccgcaagcccgcttcctcctggtgatgctcagcatgctcaccctgcagcacggcgcaaacaacctcgaccttctgctcaattccggcatgctggccctcacgcagacggcactgcgcctgattggccccagttgtgacaacgttgaggaagatatgaatgcttctgctcaaggtgcttctgccacagttttggaagaaacaaggaaggaaacggctcctgtgcagctccctgtttcaggaccagaactggctgccatgatgaagattggaacaagggtcatgagaggtgtggactggaaatggggcgatcaggatgggcctcctccaggcctaggccgcgtgattggtgagctgggagaggacggatggataagagtccagtgggacacaggcagcaccaactcctacaggatggggaaagaaggaaaatacgacctcaagctggcagagctgccggctgctgcacagccctcagcagaggattcggacacagaggatgactctgaagccgaacaaactgaaaggaacattcaccccactgcaatgatgtttaccagcactattaacttactgcagactctttgtctgtctgctggagttcatgctgagatcatgcagagcgaagccaccaagactttatgcggactgctgcgaatgttagtggaaagcggaacgacggacaagacatcttctccaaacaggctggtgtacagggagcaacaccggagctggtgcacgctggggtttgtgcggagcatcgctctcacgccgcaggtatgcggcgccctcagctccccgcagtggatcacgctgctcatgaaggtcgtggaagggcacgcacccttcactgccacctcgctgcagaggcagatcttagctgtgcatttgttgcaagcagtccttccatcatgggacaagaccgaaagggcgagggacatgaaatgcctcgtggagaagctgtttgacttcttgggaagcttgctcactacctgctcctctgacgtgccattactcagagagtccacgctgaggcggcgcagggtgcgcccgcaggcctcgctgactgccacccacagcagcacactggcggaggaggtggtggcactgctgcgcacgctgcactccctgactcagtggaatgggctcatcaacaagtacatcaactcccagctccgctccatcacccacagctttgtgggaaggccttccgaaggggcccagttagaggactacttccccgactccgagaaccctgaagtggggggcctcatggcagtcctggctgtgattggaggcatcgatggtcgcctgcgcctgggcggtcaagttatgcacgatgagtttggagaaggcactgtgactcgcatcaccccaaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggtgccagcagttgaagctatacatcctgaaagcaggtcgggcgctgctctcccaccaggataaactgcggcagatcctgtctcagccagctgttcaggagactggaactgttcacacagatgatggagcagtggtatcacctgaccttggggacatgtctcctgaagggccgcagccccccatgatcctcttgcagcagctgctggcctcggccacccagccgtctcctgtgaaggccatatttgataaacaggaacttgaggctgctgcactggccgtttgccagtgcttggctgtggagtccactcacccttcgagcccaggatttgaagactgcagctccagtgaggccaccacgcctgtcgccgtgcagcacatccgccctgccagagtgaagaggcgcaagcagtcgcccgttcccgctctgccgatcgtggtgcagctcatggagatgggattttccagaaggaacatcgagtttgccctgaagtctctcactggtgcttccgggaatgcatccagcttgcctggtgtggaagccttggtcgggtggctgctggaccactccgacatacaggtcacggagctctcagatgcagacacggtgtccgacgagtattctgacgaggaggtggtggaggacgtggatgatgccgcctactccatgtctactggtgctgttgtgacggagagccagacgtacaaaaaacgagctgatttcttgagtaatgatgattatgctgtatatgtgagagagaatattcaggtgggaatgatggttagatgctgccgagcgtatgaagaagtgtgcgaaggtgatgttggcaaagtcatcaagctggacagagatggattgcatgatctcaatgtgcagtgtgactggcagcagaaagggggcacctactgggttaggtacattcatgtggaacttataggctatcctccaccaagttcttcttctcacatcaagattggtgataaagtgcgggtcaaagcctctgtcaccacaccaaaatacaaatggggatctgtgactcatcagagtgtgggggttgtgaaagctttcagtgccaatggaaaagatatcattgtcgactttccccagcagtctcactggactgggttgctatcagaaatggagttggtacccagtattcatcctggggttacgtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggtcagtctgcggtattttgtggccgttctggaaaacagctgaagcgttgccacagcagccagccaggcatgctgctggacagctggtcccgcatggtgaagagcctgaatgtgtcgtcctccgtgaaccaggcatcccgtctcattgacggcagcgagccctgctggcagtcatcggggtcgcaaggaaagcactggattcgtttggagattttcccagatgttcttgttcatagattaaaaatgatcgtagatcctgctgacagtagctacatgccgtccctggttgtagtgtcaggtggaaattccctgaataaccttattgaactaaagacaatcaatattaacccttctgacaccacagtgccccttctgaatgactacacagagtatcacaggtatattgaaattgctataaagcagtgcaggagctcaggaatcgattgtaaaatccatggtctcatcctgctgggacggatccgtgcagaagaggaagatttggctgcagttcctttcttagcttcggataatgaagaggaggaggatgagaaaggcaacagcggaagcctcattagaaagaaggctgctgggctggaatcagcagctacgataagaaccaaggtgtttgtgtggggcctgaatgacaaggaccagctgggcgggctgaaaggctccaagataaaggttccttcgttctctgagacactgtcagctttgaatgtggtacaggtggctggtggatctaaaagtttgtttgcagtgactgtggaagggaaggtgtatgcctgtggagaagccacgaatggccggctggggctgggcatttccagcgggacggtgcccatcccacggcagatcacagctctcagcagctacgtggtcaagaaggtggctgttcactcaggtggccggcacgcgacggctttaactgtcgatggaaaagtgttttcgtggggcgaaggtgacgatggaaaacttggacacttcagcagaatgaactgtgacaaaccaaggctgatcgaggccctgaaaaccaagcgtatccgggatatcgcctgtgggagctcgcacagcgcagccctcacatccagcggagaactgtacacctggggcctcggcgagtacggccggctgggacatggggataatacgacacagctaaagcccaaaatggtgaaagtccttctcggtcacagagtaatccaggttgcatgtgggagtagagacgcgcagaccctggctctgaccgatgaaggtttggtattttcctggggtgatggtgactttggaaaactgggccggggcggaagtgaaggctgtaacattccccagaacattgagagactaaatggacagggggtgtgccagattgagtgtggagctcagttctccctggcgctcaccaagtctggagtggtgtggacatggggaaagggggattacttcagattgggccacggctctgacgtgcacgtgcggaaaccacaggtggtggaagggctgagagggaagaagatcgtgcatgtggctgtcggggccctgcactgcctggcggtcacggactcggggcaggtgtatgcttggggtgacaacgaccacggccagcagggcaatggcacgaccacggttaacaggaagcccacactcgtgcaaggcttagaaggccagaagatcacacgcgtggcttgtgggtcgtcccacagtgtggcgtggacaactgtggatgtggccacgccctctgtccacgagcccgtcctcttccagactgcaagagacccgttaggtgcttcctacttaggcgtgccctcagatgctgattcttctgctgccagtaataaaataagtggtgcaagtaattctaagccaaatcgcccttctcttgccaagattctcttgtcattggatggaaatctggccaaacagcaggccttatcgcatattcttacagcattgcaaatcatgtatgccagagatgctgttgtcggggccctgatgccggccgccatgatcgccccggtggagtgcccctcgttctcctcggcggccccttccgacgcatctgcgatggctagtcccatgaatggagaagaatgcatgctggctgttgatatcgaagacagactgagtccaaatccatggcaagaaaagagagagattgtttcctctgaggacgcagtgaccccctctgcagtgactccgtcggccccctcagcctccgctcggccttttatcccagtgacggatgacctgggagctgcaagcatcattgcagaaaccatgaccaaaaccaaagaggatgttgaaagccaaaataaagcagcaggtccggagcctcaggccttggatgagttcaccagtctgctgattgcggatgacactcgtgtggtggtagacctgctcaagctgtcagtgtgcagccgggccggggacaggggcagggatgtgctctccgcggtgctttccggcatggggaccgcctacccacaggtggcagatatgctgttggagctctgtgtcaccgagttggaggatgtggccacagactcgcagagcggccgcctctcttctcagcctgtggtggtggagagtagccacccttacaccgacgacacctccaccagtggcacagtgaagataccaggtgcagaaggactcagggtagaatttgaccggcagtgctccacagagaggcgccacgaccctctcacagtcatggacggcgtcaacaggatcgtctccgtgcggtcaggccgagagtggtccgactggtccagcgagctgcgcatcccaggggatgagttaaagtggaagttcatcagcgatgggtctgtgaatggctggggctggcgcttcaccgtctatcccatcatgccagctgctggccctaaagaactcctctctgaccgctgcgtcctctcctgtccatccatggacttggtgacgtgtctgttagacttccgactcaaccttgcctctaacagaagcatcgtccctcgccttgcggcctcgctggcagcttgtgcacagctgagtgccctagctgccagtcacagaatgtgggcccttcagagactgaggaagctgcttacaactgaatttgggcagtcaattaacataaataggctgcttggagaaaatgatggggaaacaagagctttgagttttacaggtagtgctcttgctgctttggtgaaaggtcttccagaagctttgcaaaggcagtttgaatatgaagatcctattgtgaggggtggcaaacagctgctccacagcccattctttaaggtactagtagctcttgcttgtgacctggagctggacactctgccttgctgtgccgagacgcacaagtgggcctggttccggaggtactgcatggcctcccgtgttgctgtggcccttgacaaaagaacaccgttgccccgtctgtttcttgatgaggtggctaagaaaattcgtgaattaatggcagacagcgaaaacatggatgttctgcatgagagccatgacatttttaaaagagagcaagacgaacaacttgtgcagtggatgaacaggcgaccagatgactggactctctctgctggtggcagtggaacaatttatggatggggacataatcacaggggccagctcgggggcattgaaggcgcaaaagtcaaagttcccactccctgtgaagcccttgcaactctcagacccgtgcagttaatcggaggggaacagaccctctttgctgtgacggctgatgggaagctgtatgccactgggtatggtgcaggtggcagactaggcattggagggacagagtcggtgtccaccccaacattgcttgaatccattcagcatgtgtttattaagaaagtagctgtgaactctggaggaaagcactgccttgccctgtcttcagaaggagaagtttactcttggggtgaggcagaagatgggaagttggggcatggcaacagaagtccgtgtgaccgccctcgtgtcatcgagtctctgagaggaattgaagtggtcgatgttgctgctggcggagcccacagcgcctgtgtcacagcagccggggacctctacacatggggcaaaggccgctacggccggctggggcacagcgacagtgaggaccagctgaagccgaagctggtggaggcgctgcagggccaccgtgtggttgacatcgcctgtggcagtggagatgcccagaccctctgcctcacagatgacgacactgtctggtcctggggggacggggactacggcaagctcggccggggaggcagcgatggctgtaaagtgcctatgaagattgattctcttactggtcttggagtagttaaagtggaatgcggatcccagttttctgttgcccttaccaaatctggagctgtttatacctggggcaaaggcgattatcacaggttgggccatggatcagatgaccatgttcgaaggcctcggcaggtccaagggttgcaggggaagaaagtcatcgccatcgccactggctccctgcactgtgtgtgctgcacagaggatggtgaggtttatacatggggcgacaatgatgagggacaactgggagacggaaccaccaatgccatccagaggcctcggttggtagctgcccttcagggtaagaaggtcaaccgtgtggcctgtggctcagcacataccctcgcctggtcgaccagcaagcccgccagtgctggcaaactccctgcacaggtccccatggagtacaatcacctgcaggagatccccatcattgcgctgaggaaccgtctgctgctgctgcaccacctctccgagctcttctgcccctgcatccccatgttcgacctggaaggctcgctcgacgaaactggactcgggccttctgttgggttcgacactctccgaggaattctgatatcccagggaaaggaggcggctttccggaaagtagtacaagcaactatggtacgcgatcgtcagcatggccccgtcgtggagctgaaccgcatccaggtcaaacgatcaaggagcaaaggcgggctggccggccccgacggcaccaagtctgtctttgggcagatgtgtgctaagatgagctcgtttggtcccgacagcctcctccttcctcaccgtgtctggaaagtcaagtttgtgggtgaatctgtggatgactgtgggggcggctacagcgagtccatagctgagatctgtgaggagctgcagaacggactcacgcccctgctgatcgtgacacccaacgggagggatgagtctggggccaaccgagactgctacctgctcagcccggccgccagagcacccgtgcacagcagcatgttccgcttcctgggtgtgttgctgggcattgccatccgaaccgggagtcccctgagcctcaaccttgccgagcctgtctggaagcagctggctgggatgagcctcaccatcgcggacctcagtgaggttgataaggattttattcctggactcatgtacatccgagacaatgaagccacctcagaggagtttgaagccatgagcctgcccttcacagtgccaagtgccagtggccaggacattcagttgagctccaagcacacacacatcaccctggacaaccgcgcggagtacgtgcggctggcgataaactatagactccatgaatttgatgagcaggtggctgctgttcgggaaggaatggcccgcgttgtgcctgttcccctcctctctctgttcaccggctacgaactggagacgatggtgtgtggcagccctgacatcccgctgcaccttctcaagtcggtggccacctataaaggcatcgagccttccgcatcgctgatccagtggttctgggaggtgatggagtccttctccaacacagagcgctctcttttccttcgcttcgtctggggccggacgaggctgcccaggaccatcgccgacttccggggccgagacttcgtcatccaggtgttggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagccagccgccgacgacagcagcgacgattcagataacgaggatgtcgactcctttgcttcggactctacacaagattatttaacaggacactaagatggggaaacgtcctcgtgagatgagagcctgagccaggcagcagagcactcgctgctgtgtagactgtaggctgcctggtgtgtctgatgagaagcgtccgtcctcgagccaggcgggaggagggagtggagagactgactggccgtgatgggaatgacagtgagaaggtccgcctgtgcgcgtggaacactgtggacgctcgacttccaagggtcttctcacccgtaatgctgcattacatgtaggactgtgtttactaaagtgtgtaaatgtttatataaataccaaattgcagcatccccaaaatgaataaagcctttttacttgtgggtgcaatcgatttttttttctttctcctttctttcaagtgtcgtgagtcgtcttgattgtatattggaaataactgtgtaacaaatcgtattataaatatttcaattaattttactctgaatttgtttattaaaagacttttgaacatgaaatgattagtattacttgaatgcatccagaggatatttaaaccaaaatgaaaaaccagaaggccatttggtgtcccctctcccaggtgtccccttgtagcatatgcattatgtcatctgaattgaggcctttctgtgaacagcatcataacttctatcatggaaagtgtactatatataatgtttgtgtcatgtatatgcctaaattttaatcatctataaataaaacatctgacat

SEQ ID NO: 285442 - DNA, 10158 bp, Homo sapiens
tggtggtgttctagaggtccctcataggtcgaggctgagggaatcgatataggggaacctcttactgattgtttaaaggatgttgatttgatcccgccttttaatcggatgctgctggaagtcacctttggcaagctgtacgcttgggctgtacagaacattcgaaatgttttgatggatgccagtgccacatttaaagagcttggtatccagccggttcccctccaaaccatcaccaatgagaacccgtcaggaccgagcctggggaccatcccgcaagcccgcttcctcctggtgatgctcagcatgctcaccctgcagcacggcgcaaacaacctcgaccttctgctcaattccggcatgctggccctcacgcagacggcactgcgcctgattggccccagttgtgacaacgttgaggaagatatgaatgcttctgctcaaggtgcttctgccacagttttggaagaaacaaggaaggaaacggctcctgtgcagctccctgtttcaggaccagaactggctgccatgatgaagattggaacaagggtcatgagaggtgtggactggaaatggggcgatcaggatgggcctcctccaggcctaggccgcgtgattggtgagctgggagaggacggatggataagagtccagtgggacacaggcagcaccaactcctacaggatggggaaagaaggaaaatacgacctcaagctggcagagctgccggctgctgcacagccctcagcagaggattcggacacagaggatgactctgaagccgaacaaactgaaaggaacattcaccccactgcaatgatgtttaccagcactattaacttactgcagactctttgtctgtctgctggagttcatgctgagatcatgcagagcgaagccaccaagactttatgcggactgctgcgaatgttagtggaaagcggaacgacggacaagacatcttctccaaacaggctggtgtacagggagcaacaccggagctggtgcacgctggggtttgtgcggagcatcgctctcacgccgcaggtatgcggcgccctcagctccccgcagtggatcacgctgctcatgaaggtcgtggaagggcacgcacccttcactgccacctcgctgcagaggcagatcttagctgtgcatttgttgcaagcagtccttccatcatgggacaagaccgaaagggcgagggacatgaaatgcctcgtggagaagctgtttgacttcttgggaagcttgctcactacctgctcctctgacgtgccattactcagagagtccacgctgaggcggcgcagggtgcgcccgcaggcctcgctgactgccacccacagcagcacactggcggaggaggtggtggcactgctgcgcacgctgcactccctgactcagtggaatgggctcatcaacaagtacatcaactcccagctccgctccatcacccacagctttgtgggaaggccttccgaaggggcccagttagaggactacttccccgactccgagaaccctgaagtggggggcctcatggcagtcctggctgtgattggaggcatcgatggtcgcctgcgcctgggcggtcaagttatgcacgatgagtttggagaaggcactgtgactcgcatcaccccaaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggtgccagcagttgaagctatacatcctgaaagcaggtcgggcgctgctctcccaccaggataaactgcggcagatcctgtctcagccagctgttcaggagactggaactgttcacacagatgatggagcagtggtatcacctgaccttggggacatgtctcctgaagggccgcagccccccatgatcctcttgcagcagctgctggcctcggccacccagccgtctcctgtgaaggccatatttgataaacaggaacttgaggctgctgcactggccgtttgccagtgcttggctgtggagtccactcacccttcgagcccaggatttgaagactgcagctccagtgaggccaccacgcctgtcgccgtgcagcacatccgccctgccagagtgaagaggcgcaagcagtcgcccgttcccgctctgccgatcgtggtgcagctcatggagatgggattttccagaaggaacatcgagtttgccctgaagtctctcactggtgcttccgggaatgcatccagcttgcctggtgtggaagccttggtcgggtggctgctggaccactccgacatacaggtcacggagctctcagatgcagacacggtgtccgacgagtattctgacgaggaggtggtggaggacgtggatgatgccgcctactccatgtctactggtgctgttgtgacggagagccagacgtacaaaaaacgagctgatttcttgagtaatgatgattatgctgtatatgtgagagagaatattcaggtgggaatgatggttagatgctgccgagcgtatgaagaagtgtgcgaaggtgatgttggcaaagtcatcaagctggacagagatggattgcatgatctcaatgtgcagtgtgactggcagcagaaagggggcacctactgggttaggtacattcatgtggaacttataggctatcctccaccaagttcttcttctcacatcaagattggtgataaagtgcgggtcaaagcctctgtcaccacaccaaaatacaaatggggatctgtgactcatcagagtgtgggggttgtgaaagctttcagtgccaatggaaaagatatcattgtcgactttccccagcagtctcactggactgggttgctatcagaaatggagttggtacccagtattcatcctggggttacgtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggtcagtctgcggtattttgtggccgttctggaaaacagctgaagcgttgccacagcagccagccaggcatgctgctggacagctggtcccgcatggtgaagagcctgaatgtgtcgtcctccgtgaaccaggcatcccgtctcattgacggcagcgagccctgctggcagtcatcggggtcgcaaggaaagcactggattcgtttggagattttcccagatgttcttgttcatagattaaaaatgatcgtagatcctgctgacagtagctacatgccgtccctggttgtagtgtcaggtggaaattccctgaataaccttattgaactaaagacaatcaatattaacccttctgacaccacagtgccccttctgaatgactacacagagtatcacaggtatattgaaattgctataaagcagtgcaggagctcaggaatcgattgtaaaatccatggtctcatcctgctgggacggatccgtgcagaagaggaagatttggctgcagttcctttcttagcttcggataatgaagaggaggaggatgagaaaggcaacagcggaagcctcattagaaagaaggctgctgggctggaatcagcagctacgataagaaccaaggtgtttgtgtggggcctgaatgacaaggaccagctgggcgggctgaaaggctccaagataaaggttccttcgttctctgagacactgtcagctttgaatgtggtacaggtggctggtggatctaaaagtttgtttgcagtgactgtggaagggaaggtgtatgcctgtggagaagccacgaatggccggctggggctgggcatttccagcgggacggtgcccatcccacggcagatcacagctctcagcagctacgtggtcaagaaggtggctgttcactcaggtggccggcacgcgacggctttaactgtcgatggaaaagtgttttcgtggggcgaaggtgacgatggaaaacttggacacttcagcagaatgaactgtgacaaaccaaggctgatcgaggccctgaaaaccaagcgtatccgggatatcgcctgtgggagctcgcacagcgcagccctcacatccagcggagaactgtacacctggggcctcggcgagtacggccggctgggacatggggataatacgacacagctaaagcccaaaatggtgaaagtccttctcggtcacagagtaatccaggttgcatgtgggagtagagacgcgcagaccctggctctgaccgatgaaggtttggtattttcctggggtgatggtgactttggaaaactgggccggggcggaagtgaaggctgtaacattccccagaacattgagagactaaatggacagggggtgtgccagattgagtgtggagctcagttctccctggcgctcaccaagtctggagtggtgtggacatggggaaagggggattacttcagattgggccacggctctgacgtgcacgtgcggaaaccacaggtggtggaagggctgagagggaagaagatcgtgcatgtggctgtcggggccctgcactgcctggcggtcacggactcggggcaggtgtatgcttggggtgacaacgaccacggccagcagggcaatggcacgaccacggttaacaggaagcccacactcgtgcaaggcttagaaggccagaagatcacacgcgtggcttgtgggtcgtcccacagtgtggcgtggacaactgtggatgtggccacgccctctgtccacgagcccgtcctcttccagactgcaagagacccgttaggtgcttcctacttaggcgtgccctcagatgctgattcttctgctgccagtaataaaataagtggtgcaagtaattctaagccaaatcgcccttctcttgccaagattctcttgtcattggatggaaatctggccaaacagcaggccttatcgcatattcttacagcattgcaaatcatgtatgccagagatgctgttgtcggggccctgatgccggccgccatgatcgccccggtggagtgcccctcgttctcctcggcggccccttccgacgcatctgcgatggctagtcccatgaatggagaagaatgcatgctggctgttgatatcgaagacagactgagtccaaatccatggcaagaaaagagagagattgtttcctctgaggacgcagtgaccccctctgcagtgactccgtcggccccctcagcctccgctcggccttttatcccagtgacggatgacctgggagctgcaagcatcattgcagaaaccatgaccaaaaccaaagaggatgttgaaagccaaaataaagcagcaggtccggagcctcaggccttggatgagttcaccagtctgctgattgcggatgacactcgtgtggtggtagacctgctcaagctgtcagtgtgcagccgggccggggacaggggcagggatgtgctctccgcggtgctttccggcatggggaccgcctacccacaggtggcagatatgctgttggagctctgtgtcaccgagttggaggatgtggccacagactcgcagagcggccgcctctcttctcagcctgtggtggtggagagtagccacccttacaccgacgacacctccaccagtggcacagtgaagataccaggtgcagaaggactcagggtagaatttgaccggcagtgctccacagagaggcgccacgaccctctcacagtcatggacggcgtcaacaggatcgtctccgtgcggtcaggccgagagtggtccgactggtccagcgagctgcgcatcccaggggatgagttaaagtggaagttcatcagcgatgggtctgtgaatggctggggctggcgcttcaccgtctatcccatcatgccagctgctggccctaaagaactcctctctgaccgctgcgtcctctcctgtccatccatggacttggtgacgtgtctgttagacttccgactcaaccttgcctctaacagaagcatcgtccctcgccttgcggcctcgctggcagcttgtgcacagctgagtgccctagctgccagtcacagaatgtgggcccttcagagactgaggaagctgcttacaactgaatttgggcagtcaattaacataaataggctgcttggagaaaatgatggggaaacaagagctttgagttttacaggtagtgctcttgctgctttggtgaaaggtcttccagaagctttgcaaaggcagtttgaatatgaagatcctattgtgaggggtggcaaacagctgctccacagcccattctttaaggtactagtagctcttgcttgtgacctggagctggacactctgccttgctgtgccgagacgcacaagtgggcctggttccggaggtactgcatggcctcccgtgttgctgtggcccttgacaaaagaacaccgttgccccgtctgtttcttgatgaggtggctaagaaaattcgtgaattaatggcagacagcgaaaacatggatgttctgcatgagagccatgacatttttaaaagagagcaagacgaacaacttgtgcagtggatgaacaggcgaccagatgactggactctctctgctggtggcagtggaacaatttatggatggggacataatcacaggggccagctcgggggcattgaaggcgcaaaagtcaaagttcccactccctgtgaagcccttgcaactctcagacccgtgcagttaatcggaggggaacagaccctctttgctgtgacggctgatgggaagctgtatgccactgggtatggtgcaggtggcagactaggcattggagggacagagtcggtgtccaccccaacattgcttgaatccattcagcatgtgtttattaagaaagtagctgtgaactctggaggaaagcactgccttgccctgtcttcagaaggagaagtttactcttggggtgaggcagaagatgggaagttggggcatggcaacagaagtccgtgtgaccgccctcgtgtcatcgagtctctgagaggaattgaagtggtcgatgttgctgctggcggagcccacagcgcctgtgtcacagcagccggggacctctacacatggggcaaaggccgctacggccggctggggcacagcgacagtgaggaccagctgaagccgaagctggtggaggcgctgcagggccaccgtgtggttgacatcgcctgtggcagtggagatgcccagaccctctgcctcacagatgacgacactgtctggtcctggggggacggggactacggcaagctcggccggggaggcagcgatggctgtaaagtgcctatgaagattgattctcttactggtcttggagtagttaaagtggaatgcggatcccagttttctgttgcccttaccaaatctggagctgtttatacctggggcaaaggcgattatcacaggttgggccatggatcagatgaccatgttcgaaggcctcggcaggtccaagggttgcaggggaagaaagtcatcgccatcgccactggctccctgcactgtgtgtgctgcacagaggatggtgaggtttatacatggggcgacaatgatgagggacaactgggagacggaaccaccaatgccatccagaggcctcggttggtagctgcccttcagggtaagaaggtcaaccgtgtggcctgtggctcagcacataccctcgcctggtcgaccagcaagcccgccagtgctggcaaactccctgcacaggtccccatggagtacaatcacctgcaggagatccccatcattgcgctgaggaaccgtctgctgctgctgcaccacctctccgagctcttctgcccctgcatccccatgttcgacctggaaggctcgctcgacgaaactggactcgggccttctgttgggttcgacactctccgaggaattctgatatcccagggaaaggaggcggctttccggaaagtagtacaagcaactatggtacgcgatcgtcagcatggccccgtcgtggagctgaaccgcatccaggtcaaacgatcaaggagcaaaggcgggctggccggccccgacggcaccaagtctgtctttgggcagatgtgtgctaagatgagctcgtttggtcccgacagcctcctccttcctcaccgtgtctggaaagtcaagtttgtgggtgaatctgtggatgactgtgggggcggctacagcgagtccatagctgagatctgtgaggagctgcagaacggactcacgcccctgctgatcgtgacacccaacgggagggatgagtctggggccaaccgagactgctacctgctcagcccggccgccagagcacccgtgcacagcagcatgttccgcttcctgggtgtgttgctgggcattgccatccgaaccgggagtcccctgagcctcaaccttgccgagcctgtctggaagcagctggctgggatgagcctcaccatcgcggacctcagtgaggttgataaggattttattcctggactcatgtacatccgagacaatgaagccacctcagaggagtttgaagccatgagcctgcccttcacagtgccaagtgccagtggccaggacattcagttgagctccaagcacacacacatcaccctggacaaccgcgcggagtacgtgcggctggcgataaactatagactccatgaatttgatgagcaggtggctgctgttcgggaaggaatggcccgcgttgtgcctgttcccctcctctctctgttcaccggctacgaactggagacgatggtgtgtggcagccctgacatcccgctgcaccttctcaagtcggtggccacctataaaggcatcgagccttccgcatcgctgatccagtggttctgggaggtgatggagtccttctccaacacagagcgctctcttttccttcgcttcgtctggggccggacgaggctgcccaggaccatcgccgacttccggggccgagacttcgtcatccaggtgttggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagccagccgccgacgacagcagcgacgattcagataacgaggatgtcgactcctttgcttcggactctacacaagattatttaacaggacactaagatggggaaacgtcctcgtgagatgagagcctgagccaggcagcagagcactcgctgctgtgtagactgtaggctgcctggtgtgtctgatgagaagcgtccgtcctcgagccaggcgggaggagggagtggagagactgactggccgtgatgggaatgacagtgagaaggtccgcctgtgcgcgtggaacactgtggacgctcgacttccaagggtcttctcacccgtaatgctgcattacatgtaggactgtgtttactaaagtgtgtaaatgtttatataaataccaaattgcagcatccccaaaatgaataaagcctttttacttgtgggtgcaatcgatttttttttctttctcctttctttcaagtgtcgtgagtcgtcttgattgtatattggaaataactgtgtaacaaatcgtattataaatatttcaattaattttactctgaatttgtttattaaaagacttttgaacatgaaatgattagtattacttgaatgcatccagaggatatttaaaccaaaatgaaaaaccagaaggccatttggtgtcccctctcccaggtgtccccttgtagcatatgcattatgtcatctgaattgaggcctttctgtgaacagcatcataacttctatcatggaaagtgtactatatataatgtttgtgtcatgtatatgcctaaattttaatcatctataaataaaacatctgacat

SEQ ID NO: 285443 - DNA, 8016 bp, Homo sapiens
aagagcgcgatttatccccttcgtgtgtcatccgccttcgtgtgtcatccaccttcgagcccaggatttgaagactgcagctccagtgaggccaccacgcctgtcgccgtgcagcacatccgccctgccagagtgaagaggcgcaagcagtcgcccgttcccgctctgccgatcgtggtgcagctcatggagatgggattttccagaaggaacatcgagtttgccctgaagtctctcactggtgcttccgggaatgcatccagcttgcctggtgtggaagccttggtcgggtggctgctggaccactccgacatacaggtcacggagctctcagatgcagacacggtgtccgacgagtattctgacgaggaggtggtggaggacgtggatgatgccgcctactccatgtctactggtgctgttgtgacggagagccagacgtacaaaaaacgagctgatttcttgagtaatgatgattatgctgtatatgtgagagagaatattcaggtgggaatgatggttagatgctgccgagcgtatgaagaagtgtgcgaaggtgatgttggcaaagtcatcaagctggacagagatggattgcatgatctcaatgtgcagtgtgactggcagcagaaagggggcacctactgggttaggtacattcatgtggaacttataggctatcctccaccaagttcttcttctcacatcaagattggtgataaagtgcgggtcaaagcctctgtcaccacaccaaaatacaaatggggatctgtgactcatcagagtgtgggggttgtgaaagctttcagtgccaatggaaaagatatcattgtcgactttccccagcagtctcactggactgggttgctatcagaaatggagttggtacccagtattcatcctggggttacgtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggtcagtctgcggtattttgtggccgttctggaaaacagctgaagcgttgccacagcagccagccaggcatgctgctggacagctggtcccgcatggtgaagagcctgaatgtgtcgtcctccgtgaaccaggcatcccgtctcattgacggcagcgagccctgctggcagtcatcggggtcgcaaggaaagcactggattcgtttggagattttcccagatgttcttgttcatagattaaaaatgatcgtagatcctgctgacagtagctacatgccgtccctggttgtagtgtcaggtggaaattccctgaataaccttattgaactaaagacaatcaatattaacccttctgacaccacagtgccccttctgaatgactacacagagtatcacaggtatattgaaattgctataaagcagtgcaggagctcaggaatcgattgtaaaatccatggtctcatcctgctgggacggatccgtgcagaagaggaagatttggctgcagttcctttcttagcttcggataatgaagaggaggaggatgagaaaggcaacagcggaagcctcattagaaagaaggctgctgggctggaatcagcagctacgataagaaccaaggtgtttgtgtggggcctgaatgacaaggaccagctgggcgggctgaaaggctccaagataaaggttccttcgttctctgagacactgtcagctttgaatgtggtacaggtggctggtggatctaaaagtttgtttgcagtgactgtggaagggaaggtgtatgcctgtggagaagccacgaatggccggctggggctgggcatttccagcgggacggtgcccatcccacggcagatcacagctctcagcagctacgtggtcaagaaggtggctgttcactcaggtggccggcacgcgacggctttaactgtcgatggaaaagtgttttcgtggggcgaaggtgacgatggaaaacttggacacttcagcagaatgaactgtgacaaaccaaggctgatcgaggccctgaaaaccaagcgtatccgggatatcgcctgtgggagctcgcacagcgcagccctcacatccagcggagaactgtacacctggggcctcggcgagtacggccggctgggacatggggataatacgacacagctaaagcccaaaatggtgaaagtccttctcggtcacagagtaatccaggttgcatgtgggagtagagacgcgcagaccctggctctgaccgatgaaggtttggtattttcctggggtgatggtgactttggaaaactgggccggggcggaagtgaaggctgtaacattccccagaacattgagagactaaatggacagggggtgtgccagattgagtgtggagctcagttctccctggcgctcaccaagtctggagtggtgtggacatggggaaagggggattacttcagattgggccacggctctgacgtgcacgtgcggaaaccacaggtggtggaagggctgagagggaagaagatcgtgcatgtggctgtcggggccctgcactgcctggcggtcacggactcggggcaggtgtatgcttggggtgacaacgaccacggccagcagggcaatggcacgaccacggttaacaggaagcccacactcgtgcaaggcttagaaggccagaagatcacacgcgtggcttgtgggtcgtcccacagtgtggcgtggacaactgtggatgtggccacgccctctgtccacgagcccgtcctcttccagactgcaagagacccgttaggtgcttcctacttaggcgtgccctcagatgctgattcttctgctgccagtaataaaataagtggtgcaagtaattctaagccaaatcgcccttctcttgccaagattctcttgtcattggatggaaatctggccaaacagcaggccttatcgcatattcttacagcattgcaaatcatgtatgccagagatgctgttgtcggggccctgatgccggccgccatgatcgccccggtggagtgcccctcgttctcctcggcggccccttccgacgcatctgcgatggctagtcccatgaatggagaagaatgcatgctggctgttgatatcgaagacagactgagtccaaatccatggcaagaaaagagagagattgtttcctctgaggacgcagtgaccccctctgcagtgactccgtcggccccctcagcctccgctcggccttttatcccagtgacggatgacctgggagctgcaagcatcattgcagaaaccatgaccaaaaccaaagaggatgttgaaagccaaaataaagcagcaggtccggagcctcaggccttggatgagttcaccagtctgctgattgcggatgacactcgtgtggtggtagacctgctcaagctgtcagtgtgcagccgggccggggacaggggcagggatgtgctctccgcggtgctttccggcatggggaccgcctacccacaggtggcagatatgctgttggagctctgtgtcaccgagttggaggatgtggccacagactcgcagagcggccgcctctcttctcagcctgtggtggtggagagtagccacccttacaccgacgacacctccaccagtggcacagtgaagataccaggtgcagaaggactcagggtagaatttgaccggcagtgctccacagagaggcgccacgaccctctcacagtcatggacggcgtcaacaggatcgtctccgtgcggtcaggccgagagtggtccgactggtccagcgagctgcgcatcccaggggatgagttaaagtggaagttcatcagcgatgggtctgtgaatggctggggctggcgcttcaccgtctatcccatcatgccagctgctggccctaaagaactcctctctgaccgctgcgtcctctcctgtccatccatggacttggtgacgtgtctgttagacttccgactcaaccttgcctctaacagaagcatcgtccctcgccttgcggcctcgctggcagcttgtgcacagctgagtgccctagctgccagtcacagaatgtgggcccttcagagactgaggaagctgcttacaactgaatttgggcagtcaattaacataaataggctgcttggagaaaatgatggggaaacaagagctttgagttttacaggtagtgctcttgctgctttggtgaaaggtcttccagaagctttgcaaaggcagtttgaatatgaagatcctattgtgaggggtggcaaacagctgctccacagcccattctttaaggtactagtagctcttgcttgtgacctggagctggacactctgccttgctgtgccgagacgcacaagtgggcctggttccggaggtactgcatggcctcccgtgttgctgtggcccttgacaaaagaacaccgttgccccgtctgtttcttgatgaggtggctaagaaaattcgtgaattaatggcagacagcgaaaacatggatgttctgcatgagagccatgacatttttaaaagagagcaagacgaacaacttgtgcagtggatgaacaggcgaccagatgactggactctctctgctggtggcagtggaacaatttatggatggggacataatcacaggggccagctcgggggcattgaaggcgcaaaagtcaaagttcccactccctgtgaagcccttgcaactctcagacccgtgcagttaatcggaggggaacagaccctctttgctgtgacggctgatgggaagctgtatgccactgggtatggtgcaggtggcagactaggcattggagggacagagtcggtgtccaccccaacattgcttgaatccattcagcatgtgtttattaagaaagtagctgtgaactctggaggaaagcactgccttgccctgtcttcagaaggagaagtttactcttggggtgaggcagaagatgggaagttggggcatggcaacagaagtccgtgtgaccgccctcgtgtcatcgagtctctgagaggaattgaagtggtcgatgttgctgctggcggagcccacagcgcctgtgtcacagcagccggggacctctacacatggggcaaaggccgctacggccggctggggcacagcgacagtgaggaccagctgaagccgaagctggtggaggcgctgcagggccaccgtgtggttgacatcgcctgtggcagtggagatgcccagaccctctgcctcacagatgacgacactgtctggtcctggggggacggggactacggcaagctcggccggggaggcagcgatggctgtaaagtgcctatgaagattgattctcttactggtcttggagtagttaaagtggaatgcggatcccagttttctgttgcccttaccaaatctggagctgtttatacctggggcaaaggcgattatcacaggttgggccatggatcagatgaccatgttcgaaggcctcggcaggtccaagggttgcaggggaagaaagtcatcgccatcgccactggctccctgcactgtgtgtgctgcacagaggatggtgaggtttatacatggggcgacaatgatgagggacaactgggagacggaaccaccaatgccatccagaggcctcggttggtagctgcccttcagggtaagaaggtcaaccgtgtggcctgtggctcagcacataccctcgcctggtcgaccagcaagcccgccagtgctggcaaactccctgcacaggtccccatggagtacaatcacctgcaggagatccccatcattgcgctgaggaaccgtctgctgctgctgcaccacctctccgagctcttctgcccctgcatccccatgttcgacctggaaggctcgctcgacgaaactggactcgggccttctgttgggttcgacactctccgaggaattctgatatcccagggaaaggaggcggctttccggaaagtagtacaagcaactatggtacgcgatcgtcagcatggccccgtcgtggagctgaaccgcatccaggtcaaacgatcaaggagcaaaggcgggctggccggccccgacggcaccaagtctgtctttgggcagatgtgtgctaagatgagctcgtttggtcccgacagcctcctccttcctcaccgtgtctggaaagtcaagtttgtgggtgaatctgtggatgactgtgggggcggctacagcgagtccatagctgagatctgtgaggagctgcagaacggactcacgcccctgctgatcgtgacacccaacgggagggatgagtctggggccaaccgagactgctacctgctcagcccggccgccagagcacccgtgcacagcagcatgttccgcttcctgggtgtgttgctgggcattgccatccgaaccgggagtcccctgagcctcaaccttgccgagcctgtctggaagcagctggctgggatgagcctcaccatcgcggacctcagtgaggttgataaggattttattcctggactcatgtacatccgagacaatgaagccacctcagaggagtttgaagccatgagcctgcccttcacagtgccaagtgccagtggccaggacattcagttgagctccaagcacacacacatcaccctggacaaccgcgcggagtacgtgcggctggcgataaactatagactccatgaatttgatgagcaggtggctgctgttcgggaaggaatggcccgcgttgtgcctgttcccctcctctctctgttcaccggctacgaactggagacgatggtgtgtggcagccctgacatcccgctgcaccttctcaagtcggtggccacctataaaggcatcgagccttccgcatcgctgatccagtggttctgggaggtgatggagtccttctccaacacagagcgctctcttttccttcgcttcgtctggggccggacgaggctgcccaggaccatcgccgacttccggggccgagacttcgtcatccaggtgttggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagccagccgccgacgacagcagcgacgattcagataacgaggatgtcgactcctttgcttcggactctacacaagattatttaacaggacactaagatggggaaacgtcctcgtgagatgagagcctgagccaggcagcagagcactcgctgctgtgtagactgtaggctgcctggtgtgtctgatgagaagcgtccgtcctcgagccaggcgggaggagggagtggagagactgactggccgtgatgggaatgacagtgagaaggtccgcctgtgcgcgtggaacactgtggacgctcgacttccaagggtcttctcacccgtaatgctgcattacatgtaggactgtgtttactaaagtgtgtaaatgtttatataaataccaaattgcagcatccccaaaatgaataaagcctttttacttgtgggtgcaatcgatttttttttctttctcctttctttcaagtgtcgtgagtcgtcttgattgtatattggaaataactgtgtaacaaatcgtattataaatatttcaattaattttactctgaatttgtttattaaaagacttttgaacatgaaatgattagtattacttgaatgcatccagaggatatttaaaccaaaatgaaaaaccagaaggccatttggtgtcccctctcccaggtgtccccttgtagcatatgcattatgtcatctgaattgaggcctttctgtgaacagcatcataacttctatcatggaaagtgtactatatataatgtttgtgtcatgtatatgcctaaattttaatcatctataaataaaacatctgacat

SEQ ID NO: 285444 - DNA, 906 bp, Homo sapiens
ttttcttttctggctttcgggagtgtctttgtaaactattaaaaagcgttaggtcttcagcgtatgtgtttacttgcaggcctgagacctgggaggaagctggagaaaagatgccctctgaatctttctgtttggctgcccaggctcgcctcgactccaaatggttgaaaacagatatacagcttgcattcacaagagatgggctctgtggtctgtggaatgaaatggttaaagatggagaaattgtatacactggaacagaatcaacccagaacggagagctccctcctagaaaagatgatagtgtcgaaccaagtggaacaaagaaagaagatctgaatgacaaagagaaaaaagatgaagaagaaactcctgcacctatatatagggccaagtcaattctggacagctgggtatggggcaagcaaccagatgtgaatgaactgaaggagtgtctttctgtgctggttaaagagcagcaggccctggccgtccagtcagccaccaccaccctctcagccctgcgactcaagcagaggctggtgatcttggagcgctatttcattgccttgaatagaaccgtttttcaggagaatgtcaaagttaagtggaaaagcagcggtatttctctgcctcctgtggacaaaaaaaggtaacaataaagcgaagaaagaatcctgatgccagttaaatataaaattcagactgttttgtttcagaaagtttaaggttttcaatataggctgtcttcaccttctgaaatttattcttgctttccctttttgtatgttttgtataatctggagaatggatttgccaatttgctcatgtagtaatagaccatgctgtgtaatctgtgccattattttattttattcaataaaatttttcttttcttttttttgg

SEQ ID NO: 285445 - DNA, 931 bp, Homo sapiens
ttttcttttctggctttcgggagtgtctttgtaaactattaaaaagcgttaggtcttcagcgtatgtgtttacttgcaggcctgagacctgggaggaagctggagaaaagatgccctctgaatctttctgtttggctgcccaggctcgcctcgactccaaatggttgaaaacagatatacagcttgcattcacaagagatgggctctgtggtctgtggaatgaaatggttaaagatggagaaattgtatacactggaacagaatcaacccagaacggagagctccctcctagaaaagatgatagtgtcgaaccaagtggaacaaagaaagaagatctgaatgacaaagagaaaaaagatgaagaagaaactcctgcacctatatatagggccaagtcaattctggacagctgggtatggggcaagcaaccagatgtgaatgaactgaaggagtgtctttctgtgctggttaaagagcagcaggccctggccgtccagtcagccaccaccaccctctcagccctgcgactcaagcagaggctggtgatcttggagcgctatttcattgccttgaatagaaccgtttttcaggagaatgtcaaagttaagtggaaaagcagcggtatttctctgcctcctgtggacaaaaaaagttcccggcctgcgggcaaaggtgtggaggggctcgccagagtgggatcccgagcggcgctgtcttttgcctttgccttcctgcgcagggcctggcgatcaggtacggtccctggtgtggcgcgttgttctgcttccctaatacatcaacagactgggtttcgaactcggttcagccaccatgtgccctttggctgatcccatgtgctctctgtgcctcagtttccttgcttgtgagatgagaggctgcagaggctgtttggcttttcacatctgtgctt

SEQ ID NO: 285446 - DNA, 185 bp, Homo sapiens
cagatgcagacacggtgtccgacgagtattctgacgaggaggtggtggaggacgtggatgatgccgcctactccatggtcagtgcctcccatgtgaccgcccgcacctgggccgctgtccgtctagcgctctaacagtcttacaccttggctttctctgtcccttgaaagaattaactatatcta

SEQ ID NO: 285447 - DNA, 622 bp, Homo sapiens
ttcccgaggccaacggcacctggacgggaatggtcggggagctgatcgctaggaaagcagatctggctgtggcaggcctcaccattacagctgaacgggagaaggtgattgatttctctaagccattcatgactctgggaattagcattctttaccgcgttcatatgggacgcaaacccggctatttctccttcctggacccattttctccgggcgtctggctcttcatgcttctagcctatctggccgtcagctgtgtcctcttcctggtggctcggtgggcattcacgctgatcatcatctcatcctacacggccaacctggcagccttcctgaccgtgcagcgcatggatgtgcccattgagtcagtggatgacctggctgaccagaccgccattgaatatggcacaattcacggaggctccagcatgaccttcttccaaaattcccgctaccagacctaccaacgcatgtggaattacatgtattccaagcagcccagcgtgttcgtgaagagcacagaggagggaatcgccagggtgttgaattccaactacgccttcctcctggaatccaccatgaacgagtactatcggcagcgaaactgcaacctcactcagat

SEQ ID NO: 285448 - DNA, 906 bp, Homo sapiens
  misc_feature (35)..(36): n is a, c, g, or t
gtgttttgggcctcagtatactttttgagtaatannattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285449 - DNA, 480 bp, Homo sapiens
ggcctcattgtgtgcagaagagaacatgaatgggaagctacagaagtattgaaggacagaagaacaggaaaatgggcaggagaggaaaggaaaggaaaggaagagaaggtctgaacttagcaaggtaaattaaggtccacggttcctgagggactgaacgcacagagccgagaacgtcccggagatggggtaccacgaagggtgtatcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285450 - DNA, 1600 bp, Homo sapiens
gaggcaagaattcggcacgagggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285451 - DNA, 498 bp, Homo sapiens
cgagctcggtaccccagcagcatagatattatcgactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285452 - DNA, 686 bp, Homo sapiens
ttacaatcgagctcggtacctcataggttcgcaggattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacactgaagcttgggaacaactcactctcatgttctagatcgc

SEQ ID NO: 285453 - DNA, 928 bp, Homo sapiens
  misc_feature (643)..(643): n is a, c, g, or t
  misc_feature (928)..(928): n is a, c, g, or t
ggccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcattgtgtgcagaaactgtggtgggggctgtgctgtctcctccctgcgccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaattcgcgaagctgccaaagccttagacaagcgccaagcccatctttgtgtgcttgcatccaactgtgatgagcctatgtatgtcaagttggtggaggccctttgtgctgaacaccaaatcaactaattaaggttgatgacaacaagaaactaggagaatgggtaggcctttgtanaattgacagagaggggaaacccgtaaagtggttggttgcagtgtgtagtagttaagactatggcagggtctcaggcagtgtcctgagagttttcaatgccagaatgagaataatctggtccaaaataaaacaaaaaaaaaaaaccggcgtctttggggggaaagagataaggcgggcaagtgtctccccgttgcaggaaagggccaggggaataaccgacaaggaggaaggagtaatggccagcaacgggcattttctctttcttcttttctctcctcccacccn

SEQ ID NO: 285454 - DNA, 1462 bp, Homo sapiens
aggccactgcactacagcctgggtgtctcaaaaaagaatttgtctcaaaaactttttgccaggcgcggtggctcacacctgtaatcccagcactttgggaggctgaggcaggtggagcatctgagatcaggagttcgagaccagcctggccaacttggtgaaaccccatctctactgaaaaatataagttagccgggcatggtggcaggcgccttaattgtggctatttgggaggcagaggcaggagaatccttggaacccgggaggtggaggttgcagtaagctgagatggagccattgcactcaagcctgggggacaagggcaagacttctctcaaaaaaaaaattttttttttaatttcttgattctattagagcaagtcatttttgctttctgctttgagatcctgatctccctgtaacagacaatgtaagagtagttttttcatgactcagaatctggcctggtttaatgctatattcatactagatgcttttgcattttctcttttttaaaccatttattgcttttgtttttgtttttgttttttgagacagagtctctctgttgcccagactggagtgcagtggcatgatctggctcaccgcagcctctgcctcccgtgttcaagtgattctcctgcctcagcctcctgcgtagctgggattacaggcgcctgccaccacacctggctaatttttgtatttttagtagagatggagtttcaccatggccaagctggtctcaaactcctggactcaagtgatccgcctgcctcctaaattgctggaattacaggcatgagccatcacacccagccttaagctatttattgacttgttgagaggaaaaactctatcaagaacaatggcagcctaggcaacatagtaggatcccatttctaagacaattttaaagttagctctttgtggtgatacgcagctgaagttccagctactaagaggctgaagcgggaggatagtttgagcccaagagtttcaagctgtggtgagctgattgtgtcactgtactccagcctaggtgacagagcaagacgaattatttttaagaggtgatttgaaaagattgactataactcactgattttcaacatcaatgtattatgaagttgtttttatgcttccaatcaagtgtatctttgagtggaagccacatagttggctctgtgtaattgacaaggttatgctgccactccttaggaataataaagtactttttcttgctttttgttttttagacatccagctctgtcacccaagctgcagtgtggtggcatgattgtagctcactgtaactttgaactcctgagctcaagggatcctcccgccttggcctcccagagtttttgcagggactatatgtgagccactgcgtctggtcaaaatgtagtttttcaagagtaatgctttaataaactgatttttttcccccaaagcattt

SEQ ID NO: 285455 - DNA, 2080 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285456 - DNA, 1990 bp, Homo sapiens
tggggtcggggtatactttaaatctccatggtctcagaaaggtttcttcatcgcggaccctgggaggctggttcccagagggaacttgtcctcagcgtctcctggacagtgcagcctcctgccgggcctacttctggaaggccattacagaggtcctttcaccacctgtgagaggtttgattttgggggagctccgggactctcaaggctacagtgtggactgctggcccaaggagaaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285457 - DNA, 1633 bp, Homo sapiens
tgtgcctggtacgccccggagttacgggatgaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285458 - DNA, 2604 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaacttaaaaaaaaaaaaaaaaaaaaaaaaaaaaaaaaaaaaaaaaaaaaaaaaaaagaagggggggcggcgccgggcacaaagataagttctccccctcgggggggcgccgaagacttgccgactaccccgacggttttttgttggaaagcagggggcgccccatataggagagcgagcggcgttattataaaacgaagcagcgagcgcagggccgcggggttttaacaacacgtcggggagagtggaggaaaaacagtcgtactcggggcgacatcctgtggagaagagagaccgcctatctacttgggggggggggggggaaccaactagtgggggaacaaaatcatcctactacaggaggattattaaagggcgccactaaggggagaacaatatattacaacttttaacgagggggttatattagtgggtgttaaaccacgcgcggtgaattttgactgtgagggtattaaaaaaatttgtggcttctaagggaatatttattctatgagagaaaattttttacgg

SEQ ID NO: 285459 - DNA, 2191 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaacttaaaaaaaaagatagaaagatagaatagaaaagatttttggggggaatgggcattggaaaagtgtttaaggcctttggtggggggggggggccagtggtggagtgaaaatggg

SEQ ID NO: 285460 - DNA, 2181 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaacttataccacaacaatagcaccaagagacgacgcgaaacatgcgacaaccccagacgaccacacgtacccacaagaacacggggggcgcggccagaaaaccccgg

SEQ ID NO: 285461 - DNA, 2190 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtcccagttactaagaagactaccaaaatggcatcatcttaatcttgaagcgtatttctgacattcctgaaccgttcaacccttatgagttttatagaacttatttgatggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285462 - DNA, 1902 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagctcgcccctgagttgcagctcgcccctgagttgcagctcgcccctga

SEQ ID NO: 285463 - DNA, 2221 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggtgagactccgagcctttccactgcctttcttgtactgtgttaaatcttctctcactcccttgggcttcgggggtgtcctggtaggtccgcagtctccacacccgtcactgagagccgacctcggtcctcggcattgcgcggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285464 - DNA, 1968 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttccttttggtctttcctcctacctttggtctctgggggtatggggacttttttttttttttttttttttttttttttttttttttttttttttttttttttttttttttttatttttattattttttttttttttttttttgtttttgttatgtttatgtattaaaa

SEQ ID NO: 285465 - DNA, 1960 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttactcccgggagtggagagagaaggagtgagggcactaagcatccatacccagctctacctgggacagcaggggagactggaggcaggagaggaaaggcaactgaggagagggctctgaagccagagagtgggctgaggactgtgggaccgaga

SEQ ID NO: 285466 - DNA, 2021 bp, Homo sapiens
  misc_feature (35)..(36): n is a, c, g, or t
gtgttttgggcctcagtatactttttgagtaatannattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaaggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285467 - DNA, 1916 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttcgcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285468 - DNA, 1606 bp, Homo sapiens
ggatgtgggcctgaggttttttgtcagatgtcttgtttttctctcccaggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285469 - DNA, 1918 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtcccagttactaagaagactaccaaaatggcatcatcttaatcttgaagcgtatttctgacattcctgaaccgttcaacccttatgagttttatagaacttatttgatggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctagattccggggataatcctaggtcacctgcagca

SEQ ID NO: 285470 - DNA, 2076 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgagaggggtggggtgttccctcttctggttttgccatccctcctgcagcctaaagggctccaattaggctgccctgcttgcttgcttgcttttgcagggttaggggaaggttactaggatggctcacaggctagagagaagtcctaactgcttaactttaaaatacatagagttccttggccctcatggctatttttcagggcttctggtagtgggagtcaatttgattctatttgtgcctagaaaaataaagaatgatgtgctggtgaatcttgggtcacctatgtactatactataattgaaccttacctggggacccacacgttcaggctcaggtgttttgtttcttagagcctttgttaagtttcctacgtgtgcgacattcctaaggtcttcaagtttcctattctgttttggactgggtcatgttctgtg

SEQ ID NO: 285471 - DNA, 2026 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcgagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285472 - DNA, 1697 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacatggtgggtaagccagtccatgtgggaggtacggtacgggtagaatagtgtgcaagtcagaaggggaattctgtaaatgccgttagagggaattgacaagggggaaacttaacgggggagggggggagaccggggggtgaaacgggccccggggtggttccagaggcatatagagtcctcactagaggtccactgggggtagggttgtgatgataacg

SEQ ID NO: 285473 - DNA, 1597 bp, Homo sapiens
  misc_feature (35)..(36): n is a, c, g, or t
gtgttttgggcctcagtatactttttgagtaatannattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285474 - DNA, 1246 bp, Homo sapiens
ttacaatcgagctcggtacctcataggttcgcaggattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285475 - DNA, 1449 bp, Homo sapiens
tgactttgagccgctgtttggagatgatttttacctgtttggagatgattggagcaagagtagtttatttcttaagcatttaaactgttgttatagctgaaatatttcttcatctaagtggtcttttcctgaaatcaggtcattatactgaatctatatgttgagtcttttttttttttcctttttatcttttcctaaagatgagtcctgcattagaattgtctagataaagccattgctatgaccagtgtctggggtaggggctggggctatgactaagagtgatagcaacccttcttgcgtctgtttcttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285476 - DNA, 1389 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285477 - DNA, 1335 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcgagcttcgagccaagtttgaggagtatggtccggtcatcgaatgtgacatcgtgaaagattatgccttcgtacacatggagcgggcagaggatgcagtggaggccatcaggggccttgataacacagagtttcaaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285478 - DNA, 1913 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaacttaaaaaaaaaaaaaaaaaaaaaaaaaaaaaaaaaaaaaaaaaaaaaaaaaaagaagggggggcggcgccgggcacaaagataagttctccccctcgggggggcgccgaagacttgccgactaccccgacggttttttgttggaaagcagggggcgccccatataggagagcgagcggcgttattataaaacgaagcagcgagcgcagggccgcggggttttaacaacacgtcggggagagtggaggaaaaacagtcgtactcggggcgacatcctgtggagaagagagaccgcctatctacttgggggggggggggggaaccaactagtgggggaacaaaatcatcctactacaggaggattattaaagggcgccactaaggggagaacaatatattacaacttttaacgagggggttatattagtgggtgttaaaccacgcgcggtgaattttgactgtgagggtattaaaaaaatttgtggcttctaagggaatatttattctatgagagaaaattttttacgg

SEQ ID NO: 285479 - DNA, 2021 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggtgaaccaccctctttgggtagagggctgaacacaaggctgtgtgcagaaaatggttggataagtaaaaggagaggtttggtaaagataacagctgttggctggctggtgatgaagaaataagtgtgggtgatggacttcttatgatgtagaatgcatgggacttaggggctttaccttaggcaaatgtctcctggagaaaagccactcaccttttatttggagcccctacggcttttgtgcttatcagtgcagaaacccttttctttgaaggctttctgagttactgggccttttttattttttatttttttgtagtagagcacagttcagagttcctcactctgaatttattgccctcagcacaggatcagaattctgcattttacgtgaagaacctctcaaaaacatgtcaagcgacacttataggaccagaatccttgttaagctgtcctaccttacacaaactctttaaagggttacagctcttgttgctttatattatacctgtaccaagggattgtattttgagtttaaggccactctagaattacaaggctgattttaggacttcctggggaggaggcactggggttttaggggcggtaatgactgtcttttcattggtttggggggctggactttataagattttggtgaatagagcacttagatttgtgttatcttggagtcttaaccaaatgaatcttttgtgcctggagggcagcatgggtgatatgtggattgtcacttcatttggaagcatctcaaatccccagcattttgaatgcctacatgttgctcaaaggaaatgcttgttagagcattttggattttgaattttcagatttgggatgctaaaatggtacgtagaacgcaaatattccaaaatctgaggtctgaagcaacagtggcagttcaggggtggtgatcatggtgagttgctatctgaactcttctttcacctcctttgggttcccagtgtcaaaaagagtggtgtccttttttagcttaattaagcaggactgaacaaaaataataaaaaataaaaaaagccttattcaaaaaaaaaata

SEQ ID NO: 285480 - DNA, 1248 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaactgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285481 - DNA, 552 bp, Homo sapiens
atgtgaccagaagcacgttactaacactggctagagttgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285482 - DNA, 1306 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaagtcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285483 - DNA, 1480 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcgacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctcgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 285484 - DNA, 1150 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaagacatccagctctgtcacccaagctgcagtgtggtggcatgattgtagctcactgtaactttgaactcctgagctcaagggatcctcccgccttggcctcccagagtttttgcagggactatatgtgagccactgcgtctggtcaaaatgtagtttttcaagagtaatgctttaataaactgatttttttcccccaaagcattt

SEQ ID NO: 285485 - DNA, 1399 bp, Homo sapiens
  misc_feature (1261)..(1261): n is a, c, g, or t
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaagcaagataacccctgtgacagaaggctactgttgctgtaacaaagggcatacatacattttcaagaactgcaatttaattttggagtccaggaaaagcagaagatgctgagatgtcatatatggcgaattgcactattctaaatgtgttttgttttaatctttcacagtaaacaagctttcagaaatgatggtcacaaggggtaggatatcaaggagcagccagtcattcacccaattccaacacacctacatgtcacactgtcacagagtgagagccacagttccagtagttcccctaattgaccaaatctccnttgccaaatcaaaagaaatcattcctagaattctctaatccttctattgatgatgggaactccagacaccaatggctgggggaaaaaaaaagttaactcacaccaagtttctctacttattacagacaaagggccaat

SEQ ID NO: 285486 - DNA, 1117 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggtgcggtcttgctctgttgcctaggctggagtacagtggtatgagtatggctcaatgcagcctcaaccttctgagctgaagcggtcttcccatctcaaccttccaagtagctggaactacagaggtatgcaccattgctacacggtctacttaggggatcctgctagagt

SEQ ID NO: 285487 - DNA, 1155 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggctcttgtcaggatggtgaagctgttcatcggaaaccttccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatca

SEQ ID NO: 285488 - DNA, 1182 bp, Homo sapiens
ggggtggtgcttgggaggttagagggagacacctagagtgaacggcaaaatggagcgcggaatactgtctggctgtgcacgtggaggtggcgaaatgtggaagcttaacgaagttggcgccatgaagctaaagactgctaccccggggctctagctcgctccgcctaatggcgggccgcaccccgccggcgaagcccacgtttgtaggtccgccctcacgctgatctcttgcccaatcagcgagttcggcttcgcgaggttggtgcccattggctttcgcataaaagctccgaggttacagacgtttccacctcttgccggcctcttaggtaattggcgtccgtggtaaccaatcaggaagaggatctgcgggaacgccggccttttactttcttgagtggccaatccggttgtaggctcacctcccccttctactcagagcactgctgcggccgccgccattttagcgttttgtcagaagcgtccgcgccgcgaggaggaggccctgctggtttctgtgcgggtgagactccgagcctttccactgcctttcttgtactgtgttaaatcttctctcactcccttgggcttcgggggtgtcctggtaggtccgcagtctccacacccgtcactgagagccgacctcggtcctcggcattgcgcggtaagccgggagcagcccttcccccaccgccccctgagaataccttgctttttttcgcccaccctgtcccgcgcccgacatggctgctcttggagcctcgagatttccactgggataaccccctttcccttatatctgacagttacattctcgtttcgggaatttctcgggccgtgagacatcgtctggttaatgaatctgaagctcttttccgcggccgcgcatttcagtgttcggcaggagctaggacggtgccccgagagaggcgttcaccactccagtatttcctttatctcccactcctcgctgtctgatccgagtcgcgcgttcattacttccaaaggaaactcaaatgtagctattacaaggcccattttcccggaaatgatggctgctttggttcctacgtgaggaaaagcctgttgataatttcaggcaggcagtcagcaagcctagtagacttttgttttctgttgtcctcctagtggatagaaaagcctagtacccccatttcttca

SEQ ID NO: 285489 - DNA, 2236 bp, Homo sapiens
cttccctgctccagagccgccgcctgggccggggcagggcgggcccggggctcctccatgctgccagccgcggggctgcggagccgaccaagtggctcctgcgatggcggcggaagaggaggctgcggcgggaggtaaagtgttgagagaggagaaccagtgcattgctcctgtggtttccagccgcgtgagtccagggacaagaccaacagctatggggtctttcagctcacacatgacagagtttccacgaaaacgcaaaggaagtgattcagacccatcccaagaagctcatagccaaactgaaaagcggaggagagataaaatgaataacctgattgaagaactgtctgcaatgatccctcagtgcaaccccatggcgcgtaaactggacaaacttacagttttaagaatggctgttcaacacttgagatctttaaaaggcttgacaaattcttatgtgggaagtaattatagaccatcatttcttcaggataatgagctcagacatttaatccttaagactgcagaaggcttcttatttgtggttggatgtgaaagaggaaaaattctcttcgtttctaagtcagtctccaaaatacttaattatgatcaggctagtttgactggacaaagcttatttgacttcttacatccaaaagatgttgccaaagtaaaggaacaactttcttcttttgatatttcaccaagagaaaagctaatagatgccaaaactggtttgcaagttcacagtaatctccacgctggaaggacacgtgtgtattctggctcaagacgatcttttttctgtcggataaagagttgtaaaatctctgtcaaagaagagcatggatgcttacccaactcaaagaagaaagagcacagaaaattctatactatccattgcactggttacttgagaagctggcctccaaatattgttggaatggaagaagaaaggaacagtaagaaagacaacagtaattttacctgccttgtggccattggaagattacagccatatattgttccacagaacagtggagagattaatgtgaaaccaactgaatttataacccggtttgcagtgaatggaaaatttgtctatgtagatcaaagggcaacagcgattttaggatatctgcctcaggaacttttgggaacttcttgttatgaatattttcatcaagatgaccacaataatttgactgacaagcacaaagcagttctacagagtaaggagaaaatacttacagattcctacaaattcagagcaaaagatggctcttttgtaactttaaaaagccaatggtttagtttcacaaatccttggacaaaagaactggaatatattgtatctgtcaacactttagttttgggacatagtgagcctggagaagcatcatttttaccttgtagctctcaatcatcagaagaatcctctagacagtcctgtatgagtgtacctggaatgtctactggaacagtacttggtgctggtagtattggaacagatattgcaaatgaaattctggatttacagaggttacagtcttcttcataccttgatgattcgagtccaacaggtttaatgaaagatactcatactgtaaactgcaggagtatgtcaaataaggagttgtttccaccaagtccttctgaaatgggggagctagaggctaccaggcaaaaccagagtactgttgctgtccacagccatgagccactcctcagtgatggtgcacagttggatttcgatgccctatgtgacaatgatgacacagccatggctgcatttatgaattacttagaagcagaggggggcctgggagaccctggggacttcagtgacatccagtggaccctctagcctttgatttttaactccaaaaatgagaaacattttaaagcatttcatttacgaaaaactgtctcaactattcttaagtactgtattgatattgtttgtatcttttattaatgttctaccactttttatagatttgcatcttcctgtcacagggatgtggggaaatacgttttcctcccaagagaaccaagtttattatagactcctttattcagtgaaatggcttataatccactagttgccatatttttgctaaaatatttctaaccaagaatactacttacatattgttttggctttgttttatttttgatgcagttttttttagttgaggtaatgtaatatattgatgttttcctttgtgtc

SEQ ID NO: 285490 - DNA, 2338 bp, Homo sapiens
cttccctgctccagagccgccgcctgggccggggcagggcgggcccggggctcctccatgctgccagccgcggggctgcggagccgaccaagtggctcctgcgatggcggcggaagaggaggctgcggcgggaggtaaagtgttgagagaggagaaccagtgcattgctcctgtggtttccagccgcgtgagtccagggacaagaccaacagctatggggtctttcagctcacacatgacagagtttccacgaaaacgcaaaggaagtgattcagacccatcccagtcaggaatcatgacagaaaaagtggtggaaaagctttctcagaatccccttacctatcttctttcaacaaggatagaaatatcagcctccagtggcagcagagaagctcatagccaaactgaaaagcggaggagagataaaatgaataacctgattgaagaactgtctgcaatgatccctcagtgcaaccccatggcgcgtaaactggacaaacttacagttttaagaatggctgttcaacacttgagatctttaaaaggcttgacaaattcttatgtgggaagtaattatagaccatcatttcttcaggataatgagctcagacatttaatccttaagactgcagaaggcttcttatttgtggttggatgtgaaagaggaaaaattctcttcgtttctaagtcagtctccaaaatacttaattatgatcaggctagtttgactggacaaagcttatttgacttcttacatccaaaagatgttgccaaagtaaaggaacaactttcttcttttgatatttcaccaagagaaaagctaatagatgccaaaactggtttgcaagttcacagtaatctccacgctggaaggacacgtgtgtattctggctcaagacgatcttttttctgtcggataaagagttgtaaaatctctgtcaaagaagagcatggatgcttacccaactcaaagaagaaagagcacagaaaattctatactatccattgcactggttacttgagaagctggcctccaaatattgttggaatggaagaagaaaggaacagtaagaaagacaacagtaattttacctgccttgtggccattggaagattacagccatatattgttccacagaacagtggagagattaatgtgaaaccaactgaatttataacccggtttgcagtgaatggaaaatttgtctatgtagatcaaagggcaacagcgattttaggatatctgcctcaggaacttttgggaacttcttgttatgaatattttcatcaagatgaccacaataatttgactgacaagcacaaagcagttctacagagtaaggagaaaatacttacagattcctacaaattcagagcaaaagatggctcttttgtaactttaaaaagccaatggtttagtttcacaaatccttggacaaaagaactggaatatattgtatctgtcaacactttagttttgggacatagtgagcctggagaagcatcatttttaccttgtagctctcaatcatcagaagaatcctctagacagtcctgtatgagtgtacctggaatgtctactggaacagtacttggtgctggtagtattggaacagatattgcaaatgaaattctggatttacagaggttacagtcttcttcataccttgatgattcgagtccaacaggtttaatgaaagatactcatactgtaaactgcaggagtatgtcaaataaggagttgtttccaccaagtccttctgaaatgggggagctagaggctaccaggcaaaaccagagtactgttgctgtccacagccatgagccactcctcagtgatggtgcacagttggatttcgatgccctatgtgacaatgatgacacagccatggctgcatttatgaattacttagaagcagaggggggcctgggagaccctggggacttcagtgacatccagtggaccctctagcctttgatttttaactccaaaaatgagaaacattttaaagcatttcatttacgaaaaactgtctcaactattcttaagtactgtattgatattgtttgtatcttttattaatgttctaccactttttatagatttgcatcttcctgtcacagggatgtggggaaatacgttttcctcccaagagaaccaagtttattatagactcctttattcagtgaaatggcttataatccactagttgccatatttttgctaaaatatttctaaccaagaatactacttacatattgttttggctttgttttatttttgatgcagttttttttagttgaggtaatgtaatatattgatgttttcctttgtgtc

SEQ ID NO: 285491 - DNA, 2299 bp, Homo sapiens
cttccctgctccagagccgccgcctgggccggggcagggcgggcccggggctcctccatgctgccagccgcggggctgcggagccgaccaagtggctcctgcgatggcggcggaagaggaggctgcggcgggaggtaaagtgttgagagaggagaaccagtgcattgctcctgtggtttccagccgcgtgagtccagggacaagaccaacagctatggggtctttcagctcacacatgacagagtttccacgaaaacgcaaaggaagtgattcagacccatcccatcagaatccccttacctatcttctttcaacaaggatagaaatatcagcctccagtggcagcagagaagctcatagccaaactgaaaagcggaggagagataaaatgaataacctgattgaagaactgtctgcaatgatccctcagtgcaaccccatggcgcgtaaactggacaaacttacagttttaagaatggctgttcaacacttgagatctttaaaaggcttgacaaattcttatgtgggaagtaattatagaccatcatttcttcaggataatgagctcagacatttaatccttaagactgcagaaggcttcttatttgtggttggatgtgaaagaggaaaaattctcttcgtttctaagtcagtctccaaaatacttaattatgatcaggctagtttgactggacaaagcttatttgacttcttacatccaaaagatgttgccaaagtaaaggaacaactttcttcttttgatatttcaccaagagaaaagctaatagatgccaaaactggtttgcaagttcacagtaatctccacgctggaaggacacgtgtgtattctggctcaagacgatcttttttctgtcggataaagagttgtaaaatctctgtcaaagaagagcatggatgcttacccaactcaaagaagaaagagcacagaaaattctatactatccattgcactggttacttgagaagctggcctccaaatattgttggaatggaagaagaaaggaacagtaagaaagacaacagtaattttacctgccttgtggccattggaagattacagccatatattgttccacagaacagtggagagattaatgtgaaaccaactgaatttataacccggtttgcagtgaatggaaaatttgtctatgtagatcaaagggcaacagcgattttaggatatctgcctcaggaacttttgggaacttcttgttatgaatattttcatcaagatgaccacaataatttgactgacaagcacaaagcagttctacagagtaaggagaaaatacttacagattcctacaaattcagagcaaaagatggctcttttgtaactttaaaaagccaatggtttagtttcacaaatccttggacaaaagaactggaatatattgtatctgtcaacactttagttttgggacatagtgagcctggagaagcatcatttttaccttgtagctctcaatcatcagaagaatcctctagacagtcctgtatgagtgtacctggaatgtctactggaacagtacttggtgctggtagtattggaacagatattgcaaatgaaattctggatttacagaggttacagtcttcttcataccttgatgattcgagtccaacaggtttaatgaaagatactcatactgtaaactgcaggagtatgtcaaataaggagttgtttccaccaagtccttctgaaatgggggagctagaggctaccaggcaaaaccagagtactgttgctgtccacagccatgagccactcctcagtgatggtgcacagttggatttcgatgccctatgtgacaatgatgacacagccatggctgcatttatgaattacttagaagcagaggggggcctgggagaccctggggacttcagtgacatccagtggaccctctagcctttgatttttaactccaaaaatgagaaacattttaaagcatttcatttacgaaaaactgtctcaactattcttaagtactgtattgatattgtttgtatcttttattaatgttctaccactttttatagatttgcatcttcctgtcacagggatgtggggaaatacgttttcctcccaagagaaccaagtttattatagactcctttattcagtgaaatggcttataatccactagttgccatatttttgctaaaatatttctaaccaagaatactacttacatattgttttggctttgttttatttttgatgcagttttttttagttgaggtaatgtaatatattgatgttttcctttgtgtc

SEQ ID NO: 285492 - DNA, 1589 bp, Homo sapiens
cttccctgctccagagccgccgcctgggccggggcagggcgggcccggggctcctccatgctgccagccgcggggctgcggagccgaccaagtggctcctgcgatggcggcggaagaggaggctgcggcgggaggtaaagtgttgagagaggagaaccagtgcattgctcctgtggtttccagccgcgtgagtccagggacaagaccaacagctatggggtctttcagctcacacatgacagagtttccacgaaaacgcaaaggaagtgattcagacccatcccaagaagctcatagccaaactgaaaagcggaggagagataaaatgaataacctgattgaagaactgtctgcaatgatccctcagtgcaaccccatggcgcgtaaactggacaaacttacagttttaagaatggctgttcaacacttgagatctttaaaaggcttgacaaattcttatgtgggaagtaattatagaccatcatttcttcaggataatgagctcagacatttaatccttaagactgcagaaggcttcttatttgtggttggatgtgaaagaggaaaaattctcttcgtttctaagtcagtctccaaaatacttaattatgatcaggctagtttgactggacaaagcttatttgacttcttacatccaaaagatgttgccaaagtaaaggaacaactttcttcttttgatatttcaccaagagaaaagctaatagatgccaaaactggtttgcaagttcacagtaatctccacgctggaaggacacgtgtgtattctggctcaagacgatcttttttctgtcggataaagagttgtaaaatctctgtcaaagaagagcatggatgcttacccaactcaaagaagaaagagcacagaaaattctatactatccattgcactggttacttgagaagctggcctccaaatattgttggaatggaagaagaaaggaacagtaagaaagacaacagtaattttacctgccttgtggccattggaagattacagccatatattgttccacagaacagtggagagattaatgtgaaaccaactgaatttataacccggtttgcagtgaatggaaaatttgtctatgtagatcaaaggtgacaatgatgacacagccatggctgcatttatgaattacttagaagcagaggggggcctgggagaccctggggacttcagtgacatccagtggaccctctagcctttgatttttaactccaaaaatgagaaacattttaaagcatttcatttacgaaaaactgtctcaactattcttaagtactgtattgatattgtttgtatcttttattaatgttctaccactttttatagatttgcatcttcctgtcacagggatgtggggaaatacgttttcctcccaagagaaccaagtttattatagactcctttattcagtgaaatggcttataatccactagttgccatatttttgctaaaatatttctaaccaagaatactacttacatattgttttggctttgttttatttttgatgcagttttttttagttgaggtaatgtaatatattgatgttttcctttgtgtc

SEQ ID NO: 285493 - DNA, 1660 bp, Homo sapiens
cttccctgctccagagccgccgcctgggccggggcagggcgggcccggggctcctccatgctgccagccgcggggctgcggagccgaccaagtggctcctgcgatggcggcggaagaggaggctgcggcgggaggtaaagtgttgagagaggagaaccagtgcattgctcctgtggtttccagccgcgtgagtccagggacaagaccaacagctatggggtctttcagctcacacatgacagagtttccacgaaaacgcaaaggaagtgattcagacccatcccaagaagctcatagccaaactgaaaagcggaggagagataaaatgaataacctgattgaagaactgtctgcaatgatccctcagtgcaaccccatggcgcgtaaactggacaaacttacagttttaagaatggctgttcaacacttgagatctttaaaaggcttgacaaattcttatgtgggaagtaattatagaccatcatttcttcaggataatgagctcagacatttaatccttaagactgcagaaggcttcttatttgtggttggatgtgaaagaggaaaaattctcttcgtttctaagtcagtctccaaaatacttaattatgatcaggctagtttgactggacaaagcttatttgacttcttacatccaaaagatgttgccaaagtaaaggaacaactttcttcttttgatatttcaccaagagaaaagctaatagatgccaaaactggtttgcaagttcacagtaatctccacgctggaaggacacgtgtgtattctggctcaagacgatcttttttctgtcggataaagagttgtaaaatctctgtcaaagaagagcatggatgcttacccaactcaaagaagaaagagcacagaaaattctatactatccattgcactggttacttgagaagctggcctccaaatattgttggaatggaagaagaaaggaacagtaagaaagacaacagtaattttacctgccttgtggccattggaagattacagccatatattgttccacagaacagtggagagattaatgtgaaaccaactgaatttataacccggtttgcagtgaatggaaaatttgtctatgtagatcaaagggcaacagcgattttaggatatctgcctcaggaacttttgggaacttcttgttatgaatattttcatcaagatgaccacaataatttgactgacaagcacaaagcagttctacagagtaaggagaaaatacttacagattcctacaaattcagagcaaaagatggctcttttgtaactttaaaaagccaatggtttagtttcacaaatccttggacaaaagaactggaatatattgtatctgtcaacactttagttttgggacatagtgagcctggagaagcatcatttttaccttgtagctctcaatcatcagaagaatcctctagacagtcctgtatgagtgtacctggaatgtctactggaacagtacttggtgctggtagtattggaacagatattgcaaatgaaattctggatttacagaggttacagtcttcttcataccttgatgattcgagtccaacaggtttaatgaaagatactctgtatgggggtctcgggggatcctgctagagatcgtaccaacaagcatgacagcgg

SEQ ID NO: 285494 - DNA, 495 bp, Homo sapiens
cttccctgctccagagccgccgcctgggccggggcagggcgggcccggggctcctccatgctgccagccgcggggctgcggagccgaccaagtggctcctgcgatggcggcggaagaggaggctgcggcgggaggtaaagtgttgagagaggagaaccagtgcattgctcctgtggtttccagccgcgtgagtccagggacaagaccaacagctatggggtctttcagctcacacatgacagagtttccacgaaaacgcaaaggaagtgattcagacccatcccagtcaggaatcatgacagaaaaagtggtggaaaagctttctcagaatccccttacctatcttctttcaacaaggatagaaatatcagcctccagtggcagcagagtggaagatggtgaacaccaagttaaaatgaaggccttcagatcctggctcagagagagcaccccttcctctgctgtacatcctggagtcaggagtctctatccatc

SEQ ID NO: 285495 - DNA, 218 bp, Homo sapiens
taagaatggctgttcaacacttgagatctttaaaaggtgagtttgacgatggcttccacacttcggtaagtgaaatctgctctgtcactgaggtctctgattggttcgctttgctgtcagctgttgaggttctatccagatgtgtctttcagctttagaggtattcactggcatttgtctatagtctgtatgtggagagaatactgaattggatgtca

SEQ ID NO: 285496 - DNA, 617 bp, Homo sapiens
tgcgctgccgggcccgcgaggccgagctcgccagccggatgtgtcgcctgttcttccctgttgcgttcggcactgactggggagcttgtatctgggcaaaaatggaaactttttaaaaagactgcccttaccgcgtgagagtgcgtggctttttctccaccaggggttaattaggtgcttgaacttcctcagaaaagccaatccagggtttattttcatagttcatacaagtacttcacgtggttaaagaagcccatcccggctgtgagaatagcgtgcagtagctcgcgcgttaagaacgggcagaacgccactcaaaagcacgtcgggatggtgggtttcggattggggtacagtatatcagaagtatgagccgatctttttccagtccattggaaatccgtttatttttagatgcctggatggggtactcattgatgggaatgacaaagggatatcaaaagttgtgtacagatcttgcaatgggagggatcgactcggccctttagaaatgagtgatagtacatggctaacgtcagaaattcataaccctctggctgtgggacagtatgtcaacaattgttccaatggtaagaaggcatcatggggctgtgaga

SEQ ID NO: 285497 - DNA, 1621 bp, Homo sapiens
aggccagacagccgtgacagagaaactaggcggtccgctcctgggacgcggtctcgggggcgggttcgcccctgaggcccggtgacccttcgcccgcaaccagggctagcgcttgtgtgcgcccacggaagcacccgagcgaccggagaaagaaaaagtggtcaaggggacctccttccagctctacgcgcctctcattcagagaggtgaggtcaggaaaggggaaggacgaagccccagagcaacagaagtcaggcggtgccaggaacactgagggcggagccaggggaaggcggccgagcgcggccccctctcctcccgggccggggcgggcccgaggcctcgatccgccttccccgcgccgtcctggtcacggccccgcggggcagccatgcctggccgtctgctgcggggcctgtggcagcgatggcgccgttacaagtaccgcttcgttccctggatcgcactgaacctaagccacaacccgaggaccctccgatatgttccagaggaatccaaagacaaagttatctcagatgaagatgtcctaggaacattactgaaagttttccaggctctattcttaaatgatttcaataaacaatcagaaatcttgactatgcttccagaatctgttaaatcaaaatatcaagacctactggcagttgaacatcaaggggtgaaactgcttgaaaacagacatcaacagcaaagtacctttaaaccagaagaaattctttacaagactttgggtttcagtgttgcccaagcaactagctcattgatttctgctggaaaaggtgtcttcgttactaaaggattggtaccaaaaggcgcagtcgtatctatgtatcctggtacagtatatcagaagtatgagccgatctttttccagtccattggaaatccgtttatttttagatgcctggatggggtactcattgatgggaatgacaaagggatatcaaaagttgtgtacagatcttgcaatgggagggatcgactcggccctttagaaatgagtgatagtacatggctaacgtcagaaattcataaccctctggctgtgggacagtatgtcaacaattgttccaatgacagagcagctaatgtctgttatcaggaatttgatgtgcctgcagttttccctatagaactgaagcagtatcttccaaacattgcctacagctatgacaaacaaagcccacttcgatgtgttgttcttgtcgcacttagggacatcaatcaaggagaagagcttttttcaaactactacacaattgtcagctaactctgtgaatcagaaattattaggttttctactcagctattaattctaagtgttttttgttaatcacttctctgagttctacctgtaaaacaaatattttgagacttaattggaataggaatttcttatgtttttgttgatattatatttatgttccaatttcatgataaaagctacttgcttcattacaatttcaaatttgtaatgcaattccaagtttaattggttttcacctaaatacacaatagcttattaaattaaaacctactctttgaacttataatttcaatttttcttttgtttattttgtaagctctgtggtggtttata

SEQ ID NO: 285498 - DNA, 1389 bp, Homo sapiens
aatggaataatgtaaggaccccacagcatgtggtatagaatgggcctttcataagtactgactacttgggtgggaagtgttgggagttagctaactagaactccctcaaacaattcttttctgaacttagtttccagccctccacacacatgagaataagcttatagttccttaaggccaggaacccagaagttatgcaggtaagtttggcttttatcagttgaagggtagtgaatagaaacttttcccattttcaggaccctccgatatgttccagaggaatccaaagacaaagttatctcagatgaagatgtcctaggaacattactgaaagttttccaggctctattcttaaatgatttcaataaacaatcagaaatcttgactatgcttccagaatctgttaaatcaaaatatcaagacctactggcagttgaacatcaaggggtgaaactgcttgaaaacagacatcaacagcaaagtacctttaaaccagaagaaattctttacaagactttgggtttcagtgttgcccaagcaactagctcattgatttctgctggaaaaggtgtcttcgttactaaaggattggtaccaaaaggcgcagtcgtatctatgtatcctggtacagtatatcagaagtatgagccgatctttttccagtccattggaaatccgtttatttttagatgcctggatggggtactcattgatgggaatgacaaagggatatcaaaagttgtgtacagatcttgcaatgggagggatcgactcggccctttagaaatgagtgatagtacatggctaacgtcagaaattcataaccctctggctgtgggacagtatgtcaacaattgttccaatgacagagcagctaatgtctgttatcaggaatttgatgtgcctgcagttttccctatagaactgaagcagtatcttccaaacattgcctacagctatgacaaacaaagcccacttcgatgtgttgttcttgtcgcacttagggacatcaatcaaggagaagagcttttttcaaactactacacaattgtcagctaactctgtgaatcagaaattattaggttttctactcagctattaattctaagtgttttttgttaatcacttctctgagttctacctgtaaaacaaatattttgagacttaattggaataggaatttcttatgtttttgttgatattatatttatgttccaatttcatgataaaagctacttgcttcattacaatttcaaatttgtaatgcaattccaagtttaattggttttcacctaaatacacaatagcttattaaattaaaacctactctttgaacttataatttcaatttttcttttgtttattttgtaagctctgtggtggtttata

SEQ ID NO: 285499 - DNA, 1482 bp, Homo sapiens
tgcgctgccgggcccgcgaggccgagctcgccagccggatgtgtcgcctgttcttccctgttgcgttcggcactgactggggagcttgtatctgggcaaaaatggaaactttttaaaaagactgcccttaccgcgtgagagtgcgtggctttttctccaccaggggttaattaggtgcttgaacttcctcagaaaagccaatccagggtttattttcatagttcatacaagtacttcacgtggttaaagaagcccatcccggctgtgagaatagcgtgcagtagctcgcgcgttaagaacgggcagaacgccactcaaaagcacgtcgggatggtgggtttcggattggggaccctccgatatgttccagaggaatccaaagacaaagttatctcagatgaagatgtcctaggaacattactgaaagttttccaggctctattcttaaatgatttcaataaacaatcagaaatcttgactatgcttccagaatctgttaaatcaaaatatcaagacctactggcagttgaacatcaaggggtgaaactgcttgaaaacagacatcaacagcaaagtacctttaaaccagaagaaattctttacaagactttgggtttcagtgttgcccaagcaactagctcattgatttctgctggaaaaggtgtcttcgttactaaaggattggtaccaaaaggcgcagtcgtatctatgtatcctggtacagtatatcagaagtatgagccgatctttttccagtccattggaaatccgtttatttttagatgcctggatggggtactcattgatgggaatgacaaagggatatcaaaagttgtgtacagatcttgcaatgggagggatcgactcggccctttagaaatgagtgatagtacatggctaacgtcagaaattcataaccctctggctgtgggacagtatgtcaacaattgttccaatgacagagcagctaatgtctgttatcaggaatttgatgtgcctgcagttttccctatagaactgaagcagtatcttccaaacattgcctacagctatgacaaacaaagcccacttcgatgtgttgttcttgtcgcacttagggacatcaatcaaggagaagagcttttttcaaactactacacaattgtcagctaactctgtgaatcagaaattattaggttttctactcagctattaattctaagtgttttttgttaatcacttctctgagttctacctgtaaaacaaatattttgagacttaattggaataggaatttcttatgtttttgttgatattatatttatgttccaatttcatgataaaagctacttgcttcattacaatttcaaatttgtaatgcaattccaagtttaattggttttcacctaaatacacaatagcttattaaattaaaacctactctttgaacttataatttcaatttttcttttgtttattttgtaagctctgtggtggtttata

SEQ ID NO: 285500 - DNA, 709 bp, Homo sapiens
ctttggcctgccatctcccaagggcaaacctcacaactcaggcccaagtcacaggaatctgaatggtggggtgaccttctcctctagtttaatttcattgcaatactgagaaacttcaactgttttgtctttagaagggaaattcatgtttgtgccaggccagcctttgtaaaagcctttgattggattcactagaagtctgtcttcccgcagtacatatactgtgaattttctccttcggcatttcaaccacttggaatggccactaaagtggcttttgatctaaagtaaactctgattctgtgttgatggggaaccatttctctctaacatggtggtttctttaagatgtttgatgttgggattacagacatgtgccaccacacctgtgaggccttcttttttttttttcttaagagcaaaagaatatataccaagacattgtttatcatgggaaagaggaaaaggaaacaactacacattcatcaaagatcattgaaaatctatgtaaaactccactgagtgattgtatcacccatacaatttacctctgctttctggcttttgaatgcaaatgtttaatgttatttataatatggtaatgacgattacaacattttggcagtttcatctgtgaatctcttttctctttgtttttgttttttgttttattcatttatttattgagacagagtcttgttctgtcatc

SEQ ID NO: 285501 - DNA, 2842 bp, Homo sapiens
ctttggcctgccatctcccaagggcaaacctcacaactcaggcccaagtcacaggaatctgaatggtggggtgaccttctcctctagtttaatttcattgcaatactgagaaacttcaactgttttgtctttagaagggaaattcatgtttgtgccaggccagcctttgtaaaagcctttgattggattcactagaagtctgtcttcccgcagtacatatactgtgaattttctccttcggcatttcaaccacttggaatggccactaaagtggcttttgatctaaagtaaactctgattctgtgttgatggggaaccatttctctctaacatggtggtttctttaagatgtttgacttgggccacatgagaataacagatctttgggcagtccaagcaagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttctaccagctccaaaaaatcacaattacctccaaccaacaaaacctgttgtttccccaaaaatgaaaatccattcagcaaggcaagaagagactaataaatcattttatgaagtgatcaacgtgtcacctggctatcaacttgttcggaatcgggaacagatttctgtcaccttaggggatgagatgtttgataggaaaaagcggtgggaatcggagatcccggacaaaggcagattttccaggaccaacatcatttctgacctagaagagcaaatctcagagctgacagcaataattgaacaaatgaacagagaccaccagtctgcccagaaattgctctccagtgaaatggatctccgctgtgctgagatgaaacagaactttgaaaacaagaacagggagctcaaagaggcccatgaagcagaactcagtgagttggagaacaactacaaagcagccttgaaggcagagaagttggctgcccaagagaagctagaggagatgggaaaagaatacaagtatttgaagaatatgtttcgtacgtatcaggacagtatttatgatgaaatggaagagaagtggtcaaaacagaaggcgaaatggaagaaggatgagaagttcgagcgagaaaatatcctgctacagcaaaaaaaaaagatgaccaaaaaattcgaaatggagtcaggagaagaagataagaaaataaatgaatcctgcagtgctgtctttgagaacttcattcaagagaaggaggagctcttgaaacaacatcaaagtgacaccttgcaattagaagagctgagaaaaaccaaagaggtgccctggagaagagaccaaataaatagacattggcatgatgtcctgcaacagcttcttcttatgcaggtcatgcaggaagaattgcatgcacaagcccttatcctagagtcactgaacacaaacctctactatacccagttggaactccagaaagagaaagctatagtgggaaatctggagaaaatgcttcaaaccaagtttgctgaaactgaagaaaagtataagcacaccatacagatcctgacggaagagaacattcatctgaagcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagtttagttcttgggttgctctgactctctgaatgtctgaaaatgtttgaattctcatctgaatttcacagcttatcacggactcttcactgaaaaatgatgctctccatactgggagctgagctttctctgagttttgtactatttttcttctaccttgacgtatttcgttagaaagaaactgatttgaaggccttcttcatattgaacttttactatatttgggaggtgtacctttgtcccctggggcatttaggtagcaaaaaaagatgatgtgttgattttaactctaaaatatttttctctcacacccatgccccctacttccctacctctcaatcatgttccctaacctatgacttaggaagggtttctgatgattcttaccacctcctctggaccatcaccagaattcagacacccacagtgcaggcaacataaataagtgaagtgggctagacataaggaaaacaattgcccaagcacagtgataagtggcaaccaacagcagcctcagtagaggggcttgggcagggctggggcacagcggatggggaagagtgacccacagagcactgtcccatctgaagaaggtgcttctcagacctttgccatgcaaaagcatgaggtcaatattgtcagatagtatgattttttaaaagaagttattctggtttttatgtgatatctcctaatttttaaacattgacaacaaattttaaaaatacaactgtgtgtgccgatcatgggagactcaagtagaacatgtctgtagtccagatgttttccacctgtgagatgtcattggcagaaaccaaaaccaaacacaaaaaatctccaaggagcaataagatcaaattatattttattctattaaaaaatgtttttgaaaaaagatacttaaattttaaagataacttaattcctaatgatttaaaataatccaagcagagatgaaagag

SEQ ID NO: 285502 - DNA, 2744 bp, Homo sapiens
ctttggcctgccatctcccaagggcaaacctcacaactcaggcccaagtcacaggaatctgaatggtggggtgaccttctcctctagtttaatttcattgcaatactgagaaacttcaactgttttgtctttagaagggaaattcatgtttgtgccaggccagcctttgtaaaagcctttgattggattcactagaagtctgtcttcccgcagtacatatactgtgaattttctccttcggcatttcaaccacttggaatggccactaaagtggcttttgatctaaagtaaactctgattctgtgttgatggggaaccatttctctctaacatggtggtttctttaagatgtttgacttgggccacatgagaataacagatctttgggcagtccaagcaagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttctaccagctccaaaaaatcacaattacctccaaccaacaaaacctgttgtttccccaaaaatgaaaatccattcagcaaggcaagaagagactaataaatcattttatgaagtgatcaacgtgtcacctggctatcaacttgttcggaatcgggaacagatttctgtcaccttaggggatgagatgtttgataggaaaaagcggtgggaatcggagatcccggacaaaggcagattttccaggaccaacatcatttctgacctagaagagcaaatctcagagctgacagcaataattgaacaaatgaacagagaccaccagtctgcccagaaattgctctccagtgaaatggatctccgctgtgctgagatgaaacagaactttgaaaacaagaacagaggagatgggaaaagaatacaagtatttgaagaatatgtttcgtacgtatcaggacagtatttatgatgaaatggaagagaagtggtcaaaacagaaggcgaaatggaagaaggatgagaagttcgagcgagaaaatatcctgctacagcaaaaaaaaaagatgaccaaaaaattcgaaatggagtcaggagaagaagataagaaaataaatgaatcctgcagtgctgtctttgagaacttcattcaagagaaggaggagctcttgaaacaacatcaaagtgacaccttgcaattagaagagctgagaaaaaccaaagaggtgccctggagaagagaccaaataaatagacattggcatgatgtcctgcaacagcttcttcttatgcaggtcatgcaggaagaattgcatgcacaagcccttatcctagagtcactgaacacaaacctctactatacccagttggaactccagaaagagaaagctatagtgggaaatctggagaaaatgcttcaaaccaagtttgctgaaactgaagaaaagtataagcacaccatacagatcctgacggaagagaacattcatctgaagcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagtttagttcttgggttgctctgactctctgaatgtctgaaaatgtttgaattctcatctgaatttcacagcttatcacggactcttcactgaaaaatgatgctctccatactgggagctgagctttctctgagttttgtactatttttcttctaccttgacgtatttcgttagaaagaaactgatttgaaggccttcttcatattgaacttttactatatttgggaggtgtacctttgtcccctggggcatttaggtagcaaaaaaagatgatgtgttgattttaactctaaaatatttttctctcacacccatgccccctacttccctacctctcaatcatgttccctaacctatgacttaggaagggtttctgatgattcttaccacctcctctggaccatcaccagaattcagacacccacagtgcaggcaacataaataagtgaagtgggctagacataaggaaaacaattgcccaagcacagtgataagtggcaaccaacagcagcctcagtagaggggcttgggcagggctggggcacagcggatggggaagagtgacccacagagcactgtcccatctgaagaaggtgcttctcagacctttgccatgcaaaagcatgaggtcaatattgtcagatagtatgattttttaaaagaagttattctggtttttatgtgatatctcctaatttttaaacattgacaacaaattttaaaaatacaactgtgtgtgccgatcatgggagactcaagtagaacatgtctgtagtccagatgttttccacctgtgagatgtcattggcagaaaccaaaaccaaacacaaaaaatctccaaggagcaataagatcaaattatattttattctattaaaaaatgtttttgaaaaaagatacttaaattttaaagataacttaattcctaatgatttaaaataatccaagcagagatgaaagag

SEQ ID NO: 285503 - DNA, 2565 bp, Homo sapiens
ctttggcctgccatctcccaagggcaaacctcacaactcaggcccaagtcacaggaatctgaatggtggggtgaccttctcctctagtttaatttcattgcaatactgagaaacttcaactgttttgtctttagaagggaaattcatgtttgtgccaggccagcctttgtaaaagcctttgattggattcactagaagtctgtcttcccgcagtacatatactgtgaattttctccttcggcatttcaaccacttggaatggccactaaagtggcttttgatctaaagtaaactctgattctgtgttgatggggaaccatttctctctaacatggtggtttctttaagatgtttgacttgggccacatgagaataacagatctttgggcagtccaagcaagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttctaccagctccaaaaaatcacaattacctccaaccaacaaaacctgttgtttccccaaaaatgaaaatccattcagcaaggcaagaagagactaataaatcattttatgaagtgatcaacgtgtcacctggctatcaacttgttcggaatcgggaacagatttctgtcaccttaggggatgagatgtttgataggaaaaagcggtgggaatcggagatcccggacaaaggcagattttccaggaccaacatcatttctgacctagaagagcaaatctcagagctgacagcaataattgaacaaatgaacagagaccaccagtctgcccagaaattgctctccagtgaaatggatctccgctgtgctgagatgaaacagaactttgaaaacaagaacagaggagatgggaaaagaatacaagtatttgaagaatatgtttcgtacgtatcaggacagtatttatgatgaaatggaagagaagtggtcaaaacagaaggcgaaatggaagaaggatgagaagttcgagcgagaaaatatcctgctacagcaaaaaaaaaagatgaccaaaaaattcgaaatggagtcaggagaagaagataagaaaataaatgaatcctgcagtgctgtctttgagaacttcattcaagagaaggaggagctcttgaaacaacatcaaagtgacaccttgcaattagaagagctgagaaaaaccaaagaggtcatgcaggaagaattgcatgcacaagcccttatcctagagtcactgaacacaaacctctactatacccagttggaactccagaaagaggcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagtttagttcttgggttgctctgactctctgaatgtctgaaaatgtttgaattctcatctgaatttcacagcttatcacggactcttcactgaaaaatgatgctctccatactgggagctgagctttctctgagttttgtactatttttcttctaccttgacgtatttcgttagaaagaaactgatttgaaggccttcttcatattgaacttttactatatttgggaggtgtacctttgtcccctggggcatttaggtagcaaaaaaagatgatgtgttgattttaactctaaaatatttttctctcacacccatgccccctacttccctacctctcaatcatgttccctaacctatgacttaggaagggtttctgatgattcttaccacctcctctggaccatcaccagaattcagacacccacagtgcaggcaacataaataagtgaagtgggctagacataaggaaaacaattgcccaagcacagtgataagtggcaaccaacagcagcctcagtagaggggcttgggcagggctggggcacagcggatggggaagagtgacccacagagcactgtcccatctgaagaaggtgcttctcagacctttgccatgcaaaagcatgaggtcaatattgtcagatagtatgattttttaaaagaagttattctggtttttatgtgatatctcctaatttttaaacattgacaacaaattttaaaaatacaactgtgtgtgccgatcatgggagactcaagtagaacatgtctgtagtccagatgttttccacctgtgagatgtcattggcagaaaccaaaaccaaacacaaaaaatctccaaggagcaataagatcaaattatattttattctattaaaaaatgtttttgaaaaaagatacttaaattttaaagataacttaattcctaatgatttaaaataatccaagcagagatgaaagag

SEQ ID NO: 285504 - DNA, 2686 bp, Homo sapiens
ctttggcctgccatctcccaagggcaaacctcacaactcaggcccaagtcacaggaatctgaatggtggggtgaccttctcctctagtttaatttcattgcaatactgagaaacttcaactgttttgtctttagaagggaaattcatgtttgtgccaggccagcctttgtaaaagcctttgattggattcactagaagtctgtcttcccgcagtacatatactgtgaattttctccttcggcatttcaaccacttggaatggccactaaagtggcttttgatctaaagtaaactctgattctgtgttgatggggaaccatttctctctaacatggtggtttctttaagatgtttgacttgggccacatgagaataacagatctttgggcagtccaagcaagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttctaccagctccaaaaaatcacaattacctccaaccaacaaaacctgttgtttccccaaaaatgaaaatccattcagcaaggcaagaagagactaataaatcattttatgaagtgatcaacgtgtcacctggctatcaacttgttcggaatcgggaacagatttctgtcaccttaggggatgagatgtttgataggaaaaagcggtgggaatcggagatcccggacaaaggcagattttccagggagctcaaagaggcccatgaagcagaactcagtgagttggagaacaactacaaagcagccttgaaggcagagaagttggctgcccaagagaagctagaggagatgggaaaagaatacaagtatttgaagaatatgtttcgtacgtatcaggacagtatttatgatgaaatggaagagaagtggtcaaaacagaaggcgaaatggaagaaggatgagaagttcgagcgagaaaatatcctgctacagcaaaaaaaaaagatgaccaaaaaattcgaaatggagtcaggagaagaagataagaaaataaatgaatcctgcagtgctgtctttgagaacttcattcaagagaaggaggagctcttgaaacaacatcaaagtgacaccttgcaattagaagagctgagaaaaaccaaagaggtgccctggagaagagaccaaataaatagacattggcatgatgtcctgcaacagcttcttcttatgcaggtcatgcaggaagaattgcatgcacaagcccttatcctagagtcactgaacacaaacctctactatacccagttggaactccagaaagagaaagctatagtgggaaatctggagaaaatgcttcaaaccaagtttgctgaaactgaagaaaagtataagcacaccatacagatcctgacggaagagaacattcatctgaagcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagtttagttcttgggttgctctgactctctgaatgtctgaaaatgtttgaattctcatctgaatttcacagcttatcacggactcttcactgaaaaatgatgctctccatactgggagctgagctttctctgagttttgtactatttttcttctaccttgacgtatttcgttagaaagaaactgatttgaaggccttcttcatattgaacttttactatatttgggaggtgtacctttgtcccctggggcatttaggtagcaaaaaaagatgatgtgttgattttaactctaaaatatttttctctcacacccatgccccctacttccctacctctcaatcatgttccctaacctatgacttaggaagggtttctgatgattcttaccacctcctctggaccatcaccagaattcagacacccacagtgcaggcaacataaataagtgaagtgggctagacataaggaaaacaattgcccaagcacagtgataagtggcaaccaacagcagcctcagtagaggggcttgggcagggctggggcacagcggatggggaagagtgacccacagagcactgtcccatctgaagaaggtgcttctcagacctttgccatgcaaaagcatgaggtcaatattgtcagatagtatgattttttaaaagaagttattctggtttttatgtgatatctcctaatttttaaacattgacaacaaattttaaaaatacaactgtgtgtgccgatcatgggagactcaagtagaacatgtctgtagtccagatgttttccacctgtgagatgtcattggcagaaaccaaaaccaaacacaaaaaatctccaaggagcaataagatcaaattatattttattctattaaaaaatgtttttgaaaaaagatacttaaattttaaagataacttaattcctaatgatttaaaataatccaagcagagatgaaagag

SEQ ID NO: 285505 - DNA, 392 bp, Homo sapiens
ttgacattgatacatctttcctttctttttacaggcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagtttagttcttgggttgctctgactctctgaatgtctgaaaatgtttgaattctcatctgaatttcacagcttatcacggactcttcactgaaaaatgatgctctccatactgggagctgagctttctctga

SEQ ID NO: 285506 - DNA, 339 bp, Homo sapiens
tcctggattcaagcgattctcgtgcctctgcttctcgagtagctgggactacagctcaaaaaatgacaagcttgccattaatgcgtgccattctgggaataaacaggaagttaacagagttttcctttatactgaggaaaactaagaaataaggaactacaagaaatcagttttacctcttcagaataaaaattgctgactcatcctgagtaaaaggagatttggcttttaattctaacttactaactgtggtttcaactgtctaaggtttatacttaccaggaagatgacgaatatccttaataaaatgttttcttttcggctgcatcacaacactat

SEQ ID NO: 285507 - DNA, 902 bp, Homo sapiens
ggggcttggttgaacggactcaccaggaaacgtgactttcgtgtccgacctctgctgtatcaggattcgattcttggtgttaaacaagacaacgctgaaggctcggtgcagcagccctgcaaaggagtggagccccaacccacgcagggcgtgtcttcatggcttttcctggccaatctgataccaagatgcagtggccagaagtacctgcacttccactcctgtcaagtctctgcatggctatggtgaggaagagctctgcactgggcaaggaagttggccgtcgagtgaaggaaatggtgatgctggtggcccctttccggcagtcaagttccctatcaaggacattcagttctcggaaagtggtgaaggcacacgcttccctgcatggtgcccgcctctctccactctctagaaatattagaggctaggctgctgctgtatgtcagggctagtccctcttctatgaatccagaataactctgaagaagccgagtaacaggcatgaagtgaagagaaatcgctgtaacaggaagacagcaaagcagatgctaatgaccacactatttaacgaactggaaccaacgagaaaatacggtattactgaagactgcacttccttgaacagagtgctcttctcagcaaatcggaaatgcctacacaaatcgctttacaagaaagactgtttcaaagcagcacctttctcaatgttctcgttcaggtgacaattcttcttggtctcagctccaattttattgtcattttcatcaataaggatacacatctctgccaggagttgaacctgttgcttgtcgaggtggttagtgtttatttcaggcatcattacaaaatgtctgatctgttctagaaccctaatattaaaggaaaagagaaagaaaggc

SEQ ID NO: 285508 - DNA, 1339 bp, Homo sapiens
ggggcttggttgaacggactcaccaggaaacgtgactttcgtgtccgacctctgctgtatcaggattcgattcttggtgttaaacaagacaacgctgaaggctcggtgcagcagccctgcaaaggtttttccagcgctcttgggaggtgggctgtgccactgcctggcccacctggcccacctggcccaccattacctgaagggaagcatgaacagcctttgacgtgggagtggcgactgctgagagggaactgtctgtacacaagcaatgtagccttatgggacctgagtggagccccaacccacgcagggcgtgtcttcatggcttttcctggccaatctgataccaagatgcagtggccagaagtacctgcacttccactcctgtcaagtctctgcatggctatggtgaggaagagctctgcactgggcaaggaagttggccgtcgagtgaaggaaatggtgatgctggtggcccctttccggcagtcaagttccctatcaaggacattcagttctcggaaagtggtgaaggcacacgcttccctgcatggtgcccgcctctctccactctctagaaatattagaggctaggctgctgctgtatgtcagggctagtccctcttctatgaatccagaataactctgaagaagccgagtaacaggcatgaagtgaagagaaatcgctgtaacaggaagacagcaaagcagatgctaatgaccacactatttaacgaactggaaccaacgagaaaatacggtattactgaagactgcacttccttgaacagagtgctcttctcagcaaatcggaaatgcctacacaaatcgctttacaagaaagactgtttcaaagcagcacctttctcaatgttctcgttcaggtgacaattcttcttggtctcagctccaattttattgtcattttcatcaataaggatacacatctctgccaggagttgaacctgttgcttgtcgaggtggttagtgtttatttcaggcatcattacaaaatgtctgatctgttctagaaccctaatattaaaggaaaagagaaagaaaggcaaaaaaaaaaaaacaaaaaaaaaaaaacaaaaacaaaacaaaacaacaacaaacacaaataaaaaataattaaacaaatcacacaaacaaataactacccaatcattaaatcaaacaaatacaatacacatcaccctatgcattgtcacatacatacaaatggtagcggtcacgactttccttacttcctgacacatacagcaccacacatccaccacacatcatcttctcttcctacggaatccactatcattttattatgttatacattgcc

SEQ ID NO: 285509 - DNA, 1122 bp, Homo sapiens
ggggcttggttgaacggactcaccaggaaacgtgactttcgtgtccgacctctgctgtatcaggattcgattcttggtgttaaacaagacaacgctgaaggctcggtgcagcagccctgcaaaggagtggagccccaacccacgcagggcgtgtcttcatggcttttcctggccaatctgataccaagatgcagtggccagaagtacctgcacttccactcctgtcaagtctctgcatggctatggtgaggaagagctctgcactgggcaaggaagttggccgtcgagtgaaggaaatggtgatgctggtggcccctttccggcagtcaagttccctatcaaggacattcagttctcggaaagtggtgaaggcacacgcttccctgcatggtgcccgcctctctccactctctagaaatattagaggctaggctgctgctgtatgtcagggctagtccctcttctatgaatccagaataactctgaagaagccgagtaacaggcatgaagtgaagagaaatcgctgtaacaggaagacagcaaagcagatgctaatgaccacactatttaacgaactggaaccaacgagaaatcggaaatgcctacacaaatcgctttacaagaaagactgtttcaaagcagcacctttctcaatgttctcgttcaggtgacaattcttcttggtctcagctccaattttattgtcattttcatcaataaggatacacatctctgccaggagttgaacctgttgcttgtcgaggtggttagtgtttatttcaggcatcattacaaaatgtctgatctgttctagaaccctaatattaaaggaaaagagaaagaaaggcaaaaaaaaaaaaacaaaaaaaaaaaaacaaaaacaaaacaaaacaacaacaaacacaaataaaaaataattaaacaaatcacacaaacaaataactacccaatcattaaatcaaacaaatacaatacacatcaccctatgcattgtcacatacatacaaatggtagcggtcacgactttccttacttcctgacacatacagcaccacacatccaccacacatcatcttctcttcctacggaatccactatcattttattatgttatacattgcc

SEQ ID NO: 285510 - DNA, 1472 bp, Homo sapiens
ggggcttggttgaacggactcaccaggaaacgtgactttcgtgtccgacctctgctgtatcaggattcgattcttggtgttaaacaagacaacgctgaaggctcggtgcagcagccctgcaaagctttgtgtcttaggtttcagcgtgctgacgttctctgggccctgaagtcactgctgctggctggtgtgctggccacttggtcgtgctggcctgtctcccaccgggtggatgcccagcgagctctggatgctgtgtttttccagcgctcttgggaggtgggctgtgccactgcctggcccacctggcccacctggcccaccattacctgaagggaagcatgaacagcctttgacgtgggagtggcgactgctgagagggaactgtctgtacacaagcaatgtagccttatgggacctgagtggagccccaacccacgcagggcgtgtcttcatggcttttcctggccaatctgataccaagatgcagtggccagaagtacctgcacttccactcctgtcaagtctctgcatggctatggtgaggaagagctctgcactgggcaaggaagttggccgtcgagtgaaggaaatggtgatgctggtggcccctttccggcagtcaagttccctatcaaggacattcagttctcggaaagtggtgaaggcacacgcttccctgcatggtgcccgcctctctccactctctagaaatattagaggctaggctgctgctgtatgtcagggctagtccctcttctatgaatccagaataactctgaagaagccgagtaacaggcatgaagtgaagagaaatcgctgtaacaggaagacagcaaagcagatgctaatgaccacactatttaacgaactggaaccaacgagaaaatacggtattactgaagactgcacttccttgaacagagtgctcttctcagcaaatcggaaatgcctacacaaatcgctttacaagaaagactgtttcaaagcagcacctttctcaatgttctcgttcaggtgacaattcttcttggtctcagctccaattttattgtcattttcatcaataaggatacacatctctgccaggagttgaacctgttgcttgtcgaggtggttagtgtttatttcaggcatcattacaaaatgtctgatctgttctagaaccctaatattaaaggaaaagagaaagaaaggcaaaaaaaaaaaaacaaaaaaaaaaaaacaaaaacaaaacaaaacaacaacaaacacaaataaaaaataattaaacaaatcacacaaacaaataactacccaatcattaaatcaaacaaatacaatacacatcaccctatgcattgtcacatacatacaaatggtagcggtcacgactttccttacttcctgacacatacagcaccacacatccaccacacatcatcttctcttcctacggaatccactatcattttattatgttatacattgcc

SEQ ID NO: 285511 - DNA, 1556 bp, Homo sapiens
ggggcttggttgaacggactcaccaggaaacgtgactttcgtgtccgacctctgctgtatcaggattcgattcttggtgttaaacaagacaacgctgaaggctcggtgcagcagccctgcaaagctttgtgtcttaggtttcagcgtgctgacgttctctgggccctgaagtcactgctgctggctggtgtgctggccacttggtcgtgctggcctgtctcccaccgggtggatgcccagcgagctctggatgctgtgtatgacaaagacatgggggttgtttggagtctgtgatgtgctattgtcctccacataatggttttctgcaagaaactagagaagtttttccagcgctcttgggaggtgggctgtgccactgcctggcccacctggcccacctggcccaccattacctgaagggaagcatgaacagcctttgacgtgggagtggcgactgctgagagggaactgtctgtacacaagcaatgtagccttatgggacctgagtggagccccaacccacgcagggcgtgtcttcatggcttttcctggccaatctgataccaagatgcagtggccagaagtacctgcacttccactcctgtcaagtctctgcatggctatggtgaggaagagctctgcactgggcaaggaagttggccgtcgagtgaaggaaatggtgatgctggtggcccctttccggcagtcaagttccctatcaaggacattcagttctcggaaagtggtgaaggcacacgcttccctgcatggtgcccgcctctctccactctctagaaatattagaggctaggctgctgctgtatgtcagggctagtccctcttctatgaatccagaataactctgaagaagccgagtaacaggcatgaagtgaagagaaatcgctgtaacaggaagacagcaaagcagatgctaatgaccacactatttaacgaactggaaccaacgagaaaatacggtattactgaagactgcacttccttgaacagagtgctcttctcagcaaatcggaaatgcctacacaaatcgctttacaagaaagactgtttcaaagcagcacctttctcaatgttctcgttcaggtgacaattcttcttggtctcagctccaattttattgtcattttcatcaataaggatacacatctctgccaggagttgaacctgttgcttgtcgaggtggttagtgtttatttcaggcatcattacaaaatgtctgatctgttctagaaccctaatattaaaggaaaagagaaagaaaggcaaaaaaaaaaaaacaaaaaaaaaaaaacaaaaacaaaacaaaacaacaacaaacacaaataaaaaataattaaacaaatcacacaaacaaataactacccaatcattaaatcaaacaaatacaatacacatcaccctatgcattgtcacatacatacaaatggtagcggtcacgactttccttacttcctgacacatacagcaccacacatccaccacacatcatcttctcttcctacggaatccactatcattttattatgttatacattgcc

SEQ ID NO: 285512 - DNA, 891 bp, Homo sapiens
  misc_feature (246)..(246): n is a, c, g, or t
  misc_feature (352)..(352): n is a, c, g, or t
gtcatactctttagtcggtccaggacgtgcgtgggccttgcttggtgttttttggggccgcgatgcgttcggcgcggtgcctccagatagatgcgtgtcttgtgtcccggagagttgttgggtgcgttcgggtgagggtttggtgttcatgccgcttgcgtgagggttagccaggtattcgacgttggtttctgtagaagttgccagggatgttgatgccttcacagcgtacgaccagcaccttcncggcccagcagtacctgttagccacggatggccgccgacgacttctgcaaagtgcatctcgttccagtacccgtcggccaccgccaccacgcgctcgttgtgggancggcacagggagttgatgtcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgc

SEQ ID NO: 285513 - DNA, 1050 bp, Homo sapiens
ggacgcgtgggtcgacccacgcgtcaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtgagagagagccaggactcccaggagggaaagcagggaggactgggaagggttcctggtactgggggagtgggcgagagtgaccacctctacccaggagccacctgcgccttggcactcctctgtgcctctccctgcagcccctgccacccgggctcccctcctcttctgtggtaactgtttctccccctcccccaacccagtgtctcctccaagcctgggagtggaggaggcagcagcccaggatagagaaacagtgggaatgggaggggcatagacaaacacagggaagtgacaggcttccagcttgcacagtgcctttgtagtcggcccctggtctgtagtttcagattactttttcagacgacatcagaagcccctcagcctttatccacacttagctcc

SEQ ID NO: 285514 - DNA, 830 bp, Homo sapiens
  misc_feature (11)..(12): n is a, c, g, or t
  misc_feature (14)..(14): n is a, c, g, or t
ggaagaaaagnngnaaactatactggctaggtacgaggctgggtgttacaagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggaatccaagggttggcctttccttttggtgtgggtggatgattccaaatgagcacattgctgtcggttggtggggaactgccaggcccgggggggaaattgaaaagcttgggccttgaagaattccaaagaaggttacaaaaatttgagcttcaagttccttgggcccgttttggggctttccaaaccccctcgttggacagcaagtcttgcatccggttctacccaagttgtgggacaaattcttcaactgttcacaactttcttgggacattttggggaagcttggggttggaaggttaggggggggttcctccttggggggacaccttgtggggaacccccttttaacgccactggtggaaagaccaaggtggggcttggtccttttttgggcgaacacacttaccaaatggaaagaccccgccaaaagtttttaatcccctttggcgcttttggttgggttcccgttttccctgtgacttgggactgcaaccaatttccttcaaccttggcaggaagctcaagacggggggcgaa

SEQ ID NO: 285515 - DNA, 3045 bp, Homo sapiens
cgccccggggtgcttccccttcccctctccccggccgtggcccccgcggcttagacgcctcctccgccgccgccgctcggagcaacccgggggccggatggacggggccgcggggcccggtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagtcttgcagcccccccgggactgccacccacgtgcaccccttccttggtgagccgaggcacccagacggagacagaggtggagctcaagtcatcccctggaccccctggcctgagcaatggacccccagcccctcagggggccagcgaagagcctagtgggacccaatctgaaggagggggcagcagcagcagtggtgctggctcccctggccccccggggatcctcaggcccttgcagcccccacagcgtgctgacacgccgcgaagaaattcttcctcctcctcatccccctcagagcggcctcggcagaagctctccaggaaggcaatctcctccgccaacctgttagtgcggtccgggagcacagagagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgc

SEQ ID NO: 285516 - DNA, 2120 bp, Homo sapiens
agcggcagtatctggcggtttaaggtacgaggctgggtggcagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgc

SEQ ID NO: 285517 - DNA, 2615 bp, Homo sapiens
ctcggcaccgttgaagcgtagtaccaatctgaaggagggggcagcagcagcagtggtgctggctcccctggccccccggggatcctcaggcccttgcagcccccacagcgtgctgacacgccgcgaagaaattcttcctcctcctcatccccctcagagcggcctcggcagaagctctccaggaaggcaatctcctccgccaacctgttagtgcggtccgggagcacagagagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgc

SEQ ID NO: 285518 - DNA, 2403 bp, Homo sapiens
tgctttctctcttcccaacagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgc

SEQ ID NO: 285519 - DNA, 2125 bp, Homo sapiens
gtggagaagcaaactaggctaggtagcgaggctgggttgtgccagtagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgc

SEQ ID NO: 285520 - DNA, 3304 bp, Homo sapiens
cgccccggggtgcttccccttcccctctccccggccgtggcccccgcggcttagacgcctcctccgccgccgccgctcggagcaacccgggggccggatggacggggccgcggggcccggtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagtcttgcagcccccccgggactgccacccacgtgcaccccttccttggtgagccgaggcacccagacggagacagaggtggagctcaagtcatcccctggaccccctggcctgagcaatggacccccagcccctcagggggccagcgaagagcctagtgggacccaatctgaaggagggggcagcagcagcagtggtgctggctcccctggccccccggggatcctcaggcccttgcagcccccacagcgtgctgacacgccgcgaagaaattcttcctcctcctcatccccctcagagcggcctcggcagaagctctccaggaaggcaatctcctccgccaacctgttagtgcggtccgggagcacagagagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggtgagcaggggcgtggaaacctgctggaagggtgggggacaaggtggagcccagtttgggcttggaacgctgggcgtgtgtcgttgggtgagagtccagaaacctgaagatccagcccaggaggcccctcgggaccgggaaggcttgcctggaacgcggcagtgggtggccgcggctgccggagcgcctgaaatggtgtagctctgggccgtgggtggcggtgggtaggaggtcgggctgaggccggccgctgtgctaggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgc

SEQ ID NO: 285521 - DNA, 3384 bp, Homo sapiens
cgccccggggtgcttccccttcccctctccccggccgtggcccccgcggcttagacgcctcctccgccgccgccgctcggagcaacccgggggccggatggacggggccgcggggcccggtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagtcttgcagcccccccgggactgccacccacgtgcaccccttccttggtgagccgaggcacccagacggagacagaggtggagctcaagtcatcccctggaccccctggcctgagcaatggacccccagcccctcagggggccagcgaagagcctagtgggacccaatctgaaggagggggcagcagcagcagtggtgctggctcccctggccccccggggatcctcaggcccttgcagcccccacagcgtgctgacacgccgcgaagaaattcttcctcctcctcatccccctcagagcggcctcggcagaagctctccaggaaggcaatctcctccgccaacctgttagtgcggtccgggagcacagagagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggtgagcaggggcgtggaaacctgctggaagggtgggggacaaggtggagcccagtttgggcttggaacgctgggcgtgtgtcgttgggtgagagtccagaaacctgaagatccagcccaggaggcccctcgggaccgggaaggcttgcctggaacgcggcagtgggtggccgcggctgccggagcgcctgaaatggtgtagctctgggccgtgggtggcggtgggtaggaggtcgggctgaggccggccgctgtgctaggcgtctggccggacggctccgatgggaccgacatcaactccctgtgccgctcccacaacgagcgcgtggtggcggtggccgacgacttctgcaaagtgcatctcttccagtacccgtgcgctcgtgccaaggtgaggccgcggggatcgccggggtgggaccggtgggcccgagggctcagccgccaccgcaactcttccctccggcccaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgc

SEQ ID NO: 285522 - DNA, 1806 bp, Homo sapiens
tgagacagtgccttgctctatcacccaggctggagtgcagtgcgggatttcaccatattggccaggctggtcacaaactcctggcctcaggtgacccgcccgccttggcctcccaaagtgctgggattacaggcatgagccactgcacctggcctgccctgcgacttttaatctttgcccttccctttgacctctactgtctgctctcccctcccactagaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgc

SEQ ID NO: 285523 - DNA, 3105 bp, Homo sapiens
cgccccggggtgcttccccttcccctctccccggccgtggcccccgcggcttagacgcctcctccgccgccgccgctcggagcaacccgggggccggatggacggggccgcggggcccggtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagtcttgcagcccccccgggactgccacccacgtgcaccccttccttggtgagccgaggcacccagacggagacagaggtggagctcaagtcatcccctggaccccctggcctgagcaatggacccccagcccctcagggggccagcgaagagcctagtgggacccaatctgaaggagggggcagcagcagcagtggtgctggctcccctggccccccggggatcctcaggcccttgcagcccccacagcgtgctgacacgccgcgaagaaattcttcctcctcctcatccccctcagagcggcctcggcagaagctctccaggaaggcaatctcctccgccaacctgttagtgcggtccgggagcacagagagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgcggaaacacacacaacaaacatcgaagaaccaaagacggaggcgaaaaaggcggacacgaa

SEQ ID NO: 285524 - DNA, 1210 bp, Homo sapiens
gcttcgaccgacattgatgctcgagactagttctctctctctctggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgc

SEQ ID NO: 285525 - DNA, 1498 bp, Homo sapiens
cagaggaggtggacagcacagaggaggtggacagacttcccaccaggacacctgtggccaccacgccttccccagcaccttgccttctgcctcccagaggtggccagtttgtactggtatggctgcactggctactcaaatattaatttttctgtactgactggtaaaagctgatgcttctagtaccacctgggcactccctgccgcccccagaacccctcagacttcctcttgatccagcacctaaatggttaatctccagcacagctattggcatcagttctgtggttaaatattttggtatcactccctgttcaggctccagtgatacccgggtatcccttccctctcttcccatcttctccttgggagtaagtggctttgaagttaggaggacaaggggttcactctggttccctcactagaaagacatcatcttgaattcaccttctcccctctcccaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgc

SEQ ID NO: 285526 - DNA, 1129 bp, Homo sapiens
agaatgcagttgtgacctgtcttctacatcagagcctttctgtgtgtgtctctgagcttctctgatttgccatccccaagcctacccagggtggcctccctgggggtctccttacatcctgccttttcgtcttcctatctgcctccacttccctcccttccaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgc

SEQ ID NO: 285527 - DNA, 1125 bp, Homo sapiens
gtccctcaaatccgctctttggagcctggcttgtctctgaagaggcaggtgttgaaactgcagaagtagtttgattttgtttacctggattctgacaagctatacatttggaagcactggcttcatttcttattaagcacacactgcaatcccactgtccctccgtcttagtgaacattcccgctaatccgctctttggagccttgcttgtctctgaagtaccaaacttataagaggcaggagctggtatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggcgtctggccggacggctccgatgggaccgacatcaactccctgtgccgctcccacaacgagcgcgtggtggcggtggccgacgacttctgcaaagtgcatctcttccagtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgc

SEQ ID NO: 285528 - DNA, 2484 bp, Homo sapiens
cgccccggggtgcttccccttcccctctccccggccgtggcccccgcggcttagacgcctcctccgccgccgccgctcggagcaacccgggggccggatggacggggccgcggggcccggtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagtcttgcagcccccccgggactgccacccacgtgcaccccttccttggtgagccgaggcacccagacggagacagaggtggagctcaagtcatcccctggaccccctggcctgagcaatggacccccagcccctcagggggccagcgaagagcctagtgggacccaatctgaaggagggggcagcagcagcagtggtgctggctcccctggccccccggggatcctcaggcccttgcagcccccacagcgtgctgacacgccgcgaagaaattcttcctcctcctcatccccctcagagcggcctcggcagaagctctccaggaaggcaatctcctccgccaacctgttagtgcggtccgggagcacagagagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtgagagagagccaggactcccaggagggaaagcagggaggactgggaagggttcctggtactgggggagtgggcgagagtgaccacctctacccaggagccacctgcgccttggcactcctctgtgcctctccctgcagcccctgccacccgggctcccctcctcttctgtggtaactgtttctccccctcccccaacccagtgtctcctccaagcctgggagtggaggaggcagcagcccaggatagagaaacagtgggaatgggaggggcatagacaaacacagggaagtgacaggcttccagcttgcacagtgcctttgtagtcggcccctggtctgtagtttcagattactttttcagacgacatcagaagcccctcagcctttatccacacttagctcc

SEQ ID NO: 285529 - DNA, 1805 bp, Homo sapiens
cgccccggggtgcttccccttcccctctccccggccgtggcccccgcggcttagacgcctcctccgccgccgccgctcggagcaacccgggggccggatggacggggccgcggggcccggtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagtcttgcagcccccccgggactgccacccacgtgcaccccttccttggtgagccgaggcacccagacggagacagaggtggagctcaagtcatcccctggaccccctggcctgagcaatggacccccagcccctcagggggccagcgaagagcctagtgggacccaatctgaaggagggggcagcagcagcagtggtgctggctcccctggccccccggggatcctcaggcccttgcagcccccacagcgtgctgacacgccgcgaagaaattcttcctcctcctcatccccctcagagcggcctcggcagaagctctccaggaaggcaatctcctccgccaacctgttagtgcggtccgggagcacagagagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggtgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggatgattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgaacggcgcccctgcacacactgtttagacccgctggctgagccgggcagccccagcctaggccttgactcccgctgcctgctgaggggcaataaaccagaaccaaagtcgc

SEQ ID NO: 285530 - DNA, 969 bp, Homo sapiens
cagaggaggtggacagcacagaggaggtggacagacttcccaccaggacacctgtggccaccacgccttccccagcaccttgccttctgcctcccagaggtggccagtttgtactggtatggctgcactggctactcaaatattaatttttctgtactgactggtaaaagctgatgcttctagtaccacctgggcactccctgccgcccccagaacccctcagacttcctcttgatccagcacctaaatggttaatctccagcacagctattggcatcagttctgtggttaaatattttggtatcactccctgttcaggctccagtgatacccgggtatcccttccctctcttcccatcttctccttgggagtaagtggctttgaagttaggaggacaaggggttcactctggttccctcactagaaagacatcatcttgaattcaccttctcccctctcccaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacggtgagcaggggcgtggaaacctgctggaagggtaaggctcctaagcgatccgctagatcacct

SEQ ID NO: 285531 - DNA, 377 bp, Homo sapiens
aacaaactaaaaaagaagaatgcagttgtgacctgtcttctacatcagagcctttctgtgtgtgtctctgagcttctctgatttgccatccccaagcctacccagggtggcctccctgggggtctccttacatcctgccttttcgtcttcctatctgcctccacttccctcccttccaggtggttggttttggacacagagaccagagagatcgtgtctgatgtcattgatggcaatgagcagctctcagtggtccggtacagcccaggtgggagccaccccaaccctggactcacatgcgtccctggcccttccctctctgagtgactgtatttgcagatgggttgtacctggccattggttcccatgacaacgtg

SEQ ID NO: 285532 - DNA, 376 bp, Homo sapiens
ttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatggtgaggagtccggggctggtgggcttggcaggaagagggtctggggggatggagaagcaggagaaaagagttgccttgctgctctgcaagcttggagaaggtgtcttggatggtcttgagagaccctttccctagagtgtcttccccctgccttagccttgctgttcaccctgatggtgttcgggtagcctcgggacagacagct

SEQ ID NO: 285533 - DNA, 1063 bp, Homo sapiens
aggatgggggcggggcgctggcgacatggcgcgctgattggccggcgccgcgctccaaggctgttaacggcgtctgggccgggctacggctccaaaacaaagggcaggcggcccgcggggcggcggcgggaggatgcctcgcgccctgcctaggcgttaacggcctcagcgcgtcccgggccgcgccgggaacgcctgagagccgagcccgcgctgaccggggcccgggccggatgggcgctgcgggccggggcgcggaccgcggagcggccgttacgtttttctctcgtcccagctgtgtggacagtgccacacgccctcctggacaacgacggctcttgcgtgcattttccagtgttgcttttgtcagagaggccagcagagccacggttcttccagaaccagccctgagctgagtgaggagtgcccaggagagatggtgaaaatgacaaagtccaaaactttccaagcgtatctgccgaactgtcaccgaacgtacagctgtatccactgcagagcacacctggccaatcatgacgagctcatctccaagtcctttcaggggagccagggacgcgcctacctcttcaattccgtggtgaacgtgggctgcggccctgcagaggagagggtccttctcaccgggctgcatgcggttgccgacatctactgcgagaactgcaagaccacgctcgggtggaaatacgagcatgcctttgagagcagtcagaaatataaggaaggaaaattcatcattgagcttgctcatatgatcaaagacaatggctgggagtaatgtgcgaactttcccttctccttcgaatgctgttttgtgaaagaaactgtgaatgtaatggaaacgtaggagcatctggtgacagcctttcttgccctctgacctcaaaggctagctgcgcatagctcttgacactcccggccatctctgtgggtaaggtgtccctcggatctgtcctcttcgtgtacacagttgtttctgaaaattttcaatgagctttttctaacttctcaagttctagagaaagaattaaccaactgatgactt

SEQ ID NO: 285534 - DNA, 2458 bp, Homo sapiens
aggatgggggcggggcgctggcgacatggcgcgctgattggccggcgccgcgctccaaggctgttaacggcgtctgggccgggctacggctccaaaacaaagggcaggcggcccgcggggcggcggcgggaggatgcctcgcgccctgcctaggcgttaacggcctcagcgcgtcccgggccgcgccgggaacgcctgagagccgagcccgcgctgaccggggcccgggccggatgggcgctgcgggccggggcgcggaccgcggagcggccgttacgtttttctctcgtcccagctgtgtggacagtgccacacgccctcctggacaacgacggctcttgcgtgcattttccagtgttgcttttgtcagagaggccagcagagccacggttcttccagaaccagccctgagctgagtgaggagtgcccaggagagatggtgaaaatgacaaagtccaaaactttccaagcgtatctgccgaactgtcaccgaacgtacagctgtatccactgcagagcacacctggccaatcatgacgagctcatctccaagtcctttcaggggagccagggacgcgcctacctcttcaattccgtggtgaacgtgggctgcggccctgcagaggagagggtccttctcaccgggctgcatgcggttgccgacatctactgcgagaactgcaagaccacgctcgggtggaaatacgagcatgcctttgagagcagtcagaaatataaggaaggaaaattcatcattgagcttgctcatatgatcaaagacaatggctgggagtaatgtgcgaactttcccttctccttcgaatgctgttttgtgaaagaaactgtgaatgtaatggaaacgtaggagcatctggtgacagcctttcttgccctctgacctcaaaggctagctgcgcatagctcttgacactcccggccatctctgtgggtaaggtgtccctcggatctgtcctcttcgtgtacacagttgtttctgaaaattttcaatgagctttttctaacttctcaagttctagagaaagaattaaccaactgatgacttacctgcctagttaatatcttcctttcacctttgtcttcaatatagttgggctctgcttttttaaggttcagttgaaaaccaaactggggccgggtgcggtggctcacgcctgtaatcccagcactttgggaggccaagatgggtggatcacctgaggtcaggagttctagatcagcctggccaacatggtgaaaccccatctctactaaaaatacgaaaattagccgggcatggtggcgagtgcctgtaatcttagctactcaggaggctaaggcaggagaatcacttgaacctgggacacggaggttgcagtgagctaagatcatgccatcgcactccagcctgggggacaaaagtgagacatcgtctcaaaaaaaaaaaaaaaagctgggtatggtggcgcatgcctttaatcccagctactcgggaggctgaggcacgagaatcacttgaacccaggaggcggaggttgcagtgagccaagatcgcgccactgcactccagcctggcaatagggcgagactccgtctcaatttaaaacaagagagaaccagactgagtctctgaagaccacagggacagggtctctttagatagcaagtctcaccattcccttttttagagaaaaggtattgtagcccaccctccaccccgctgtttttcttaaatttgcagaacttcaaattggctattcctcttgcaaatgaacccttaaagtacagtgttatttaagaatcttccagaggcagtcaacagacttatacactaagggcatttttggtttttagcttgttcaaaaacagaggccagcacagatgacattttagatacactctaaattgagaatggtgtctagtggaacatgtttatttaagccagtagattccttatctagaaagcaggtgagctagcccttagagaaggctgtcccggggcccgcagaggtgcccttactgaggtgacagcctcacagggtctggtaccaggggttgtgccctcagcagtgacagcagcttaggtgtcaggcagttgctgagtggctggtccatgtctatagagtaacacactggaccgaggaaaagtcagatttcattttctaccctggatgtacttgaagaaaaagaattatttttgcatatgaaagaggccagaacccacaggaaaaacttcaaaacttgacatttgccagaatgtttaaaatttgttcagaaaaggttaaagcaacaagtttagcctttgtgcatgaagacgcctggcctgctagacgcgttgcccgtccctgcgtggtgctgtcccatgtcacttgaactgatagaggggcctgtgcaatctcctaaggcctgtgtttctgccatatattttattataaattacaatccactcatccacctgccc

SEQ ID NO: 285535 - DNA, 1800 bp, Homo sapiens
gaaaagtgaaaccttctgtcctgaaacctttgtctcttctttttcaaggagcatgcctttgagagcagtcagaaatataaggaaggaaaattcatcattgagcttgctcatatgatcaaagacaatggctgggagtaatgtgcgaactttcccttctccttcgaatgctgttttgtgaaagaaactgtgaatgtaatggaaacgtaggagcatctggtgacagcctttcttgccctctgacctcaaaggctagctgcgcatagctcttgacactcccggccatctctgtgggtaaggtgtccctcggatctgtcctcttcgtgtacacagttgtttctgaaaattttcaatgagctttttctaacttctcaagttctagagaaagaattaaccaactgatgacttacctgcctagttaatatcttcctttcacctttgtcttcaatatagttgggctctgcttttttaaggttcagttgaaaaccaaactggggccgggtgcggtggctcacgcctgtaatcccagcactttgggaggccaagatgggtggatcacctgaggtcaggagttctagatcagcctggccaacatggtgaaaccccatctctactaaaaatacgaaaattagccgggcatggtggcgagtgcctgtaatcttagctactcaggaggctaaggcaggagaatcacttgaacctgggacacggaggttgcagtgagctaagatcatgccatcgcactccagcctgggggacaaaagtgagacatcgtctcaaaaaaaaaaaaaaaagctgggtatggtggcgcatgcctttaatcccagctactcgggaggctgaggcacgagaatcacttgaacccaggaggcggaggttgcagtgagccaagatcgcgccactgcactccagcctggcaatagggcgagactccgtctcaatttaaaacaagagagaaccagactgagtctctgaagaccacagggacagggtctctttagatagcaagtctcaccattcccttttttagagaaaaggtattgtagcccaccctccaccccgctgtttttcttaaatttgcagaacttcaaattggctattcctcttgcaaatgaacccttaaagtacagtgttatttaagaatcttccagaggcagtcaacagacttatacactaagggcatttttggtttttagcttgttcaaaaacagaggccagcacagatgacattttagatacactctaaattgagaatggtgtctagtggaacatgtttatttaagccagtagattccttatctagaaagcaggtgagctagcccttagagaaggctgtcccggggcccgcagaggtgcccttactgaggtgacagcctcacagggtctggtaccaggggttgtgccctcagcagtgacagcagcttaggtgtcaggcagttgctgagtggctggtccatgtctatagagtaacacactggaccgaggaaaagtcagatttcattttctaccctggatgtacttgaagaaaaagaattatttttgcatatgaaagaggccagaacccacaggaaaaacttcaaaacttgacatttgccagaatgtttaaaatttgttcagaaaaggttaaagcaacaagtttagcctttgtgcatgaagacgcctggcctgctagacgcgttgcccgtccctgcgtggtgctgtcccatgtcacttgaactgatagaggggcctgtgcaatctcctaaggcctgtgtttctgccatatattttattataaattacaatccactcatccacctgccc

SEQ ID NO: 285536 - DNA, 1097 bp, Homo sapiens
gcggccgccaccgactccccgtctgcttccctccgggcggcagccgcggtttggagcttgctgacagctctgcgaccggcgggcgcagcctcgtctcgtgcttccacgttatcctatcagggacggggcggggcggcggcctccgcagcctatcagcgcgaaccacgaccccggcgagcccgggaggaaagccgccagaaagaaggcgattggatggcggcggcgctctggggcgtagcgtcgcccgggccccgcccaccgctgccttcctctgctgggctccagagccactgaggcctgagcgagagccgacggcgggcgggcgcagctgctgccggagcgccggcgcgtgctggtgggccacacacctttcctcctcttcactcgcgagccctcggacatggtggcccccggctccgtgaccagccggctgggctcggtattccccttcctgctagtcctggtggatctgcagtacgaaggtgctgaatgtggagtaaatgcagatgttgagaaacatcttgaattgggcaagaaattacttgcagctggacagctagctgatgctttatctcagtttcatgctgccgtagatggtgaccctgataactatattgcttattatcggagggctactgtctttttagctatgggcaaatcaaaagctgcacttcctgatttaactaaagtgattcaattgaagatggacttcactgcagcaagattacagagaggtcacttattactcaaacaaggaaaacttgatgaagcagaagatgattttaaaaaagtggtgtttcctgttccttctctgttgggactccagcgttctctcctagatgatctatacttgctattttggttcttccttatgaagaaggtgactttcagatgcctctcgtcagccatctctgaatgccttcctcagtctttaaatttgatgaagttcaatttgttgatttcctttttacttctgtggactgtgcgtttggtgtcatgtctaagaagtattcactacgccgtaggatctaaaacttttctcatatcttctaaaagttttatggttttgtgttttatttttaagcccatagtctatt

SEQ ID NO: 285537 - DNA, 6163 bp, Homo sapiens
  misc_feature (3132)..(3133): n is a, c, g, or t
aaattattcacaaaaagcagctggaaatcagaaaggcagctgccgctccagggtctcaaatccattaaaaccaccacagaacaattaaaacaatcagagagagaaaaggaaaaggaaacaacgtccaacatttggcatttggttttatccacaggttttcccagagctcctcttggaattgaaagcaaaatatattggcaaacactgcttctcaatacacaggaaggggagcctcagtgcctcctgccaacagaggcggctctgtgcagtcagactgtggggtgcacagcagtctctcaggctggggtttctggcctctttccatccaatcaccccttccaggaaattcagcagcctaccagacactgggcctctgcctggctgccctttcccccaggcagagcggccttgggcataataccaggcaacctgccagccccagagcagaaaccctgctgggatcccttccttcatcaaccttggtgtggaggatgctcaatagcgcttccacctccccctccccagcccctagctacatctctccacccttccctggacagtcctacttcccagctcacccacccaccagcagcttaagtctgggtgggatctatcatcagctcctccccctgtaacctcttccctccacagatccaccctgtgactcctcttcactcgcgagccctcggacatggtggcccccggctccgtgaccagccggctgggctcggtattccccttcctgctagtcctggtggatctgcagtacgaaggtgctgaatgtggagtaaatgcagatgttgagaaacatcttgaattgggcaagaaattacttgcagctggacagctagctgatgctttatctcagtttcatgctgccgtagatggtgaccctgataactatattgcttattatcggagggctactgtctttttagctatgggcaaatcaaaagctgcacttcctgatttaactaaagtgattcaattgaagatggacttcactgcagcaagattacagagaggtcacttattactcaaacaaggaaaacttgatgaagcagaagatgattttaaaaaagtgctcaaatctaatccaagtgaaaatgaagaaaaggaagcacagtctcaacttataaaatctgatgaaatgcagcgtttgcgttcacaagcacttaacgcttttggaagtggagattatactgctgctatagccttccttgataagattttagaggtttgtgtttgggatgcagaactacgggaacttcgagctgaatgttttataaaagaaggagaacctaggaaagctataagtgacttaaaagctgcgtcaaagttgaagaatgataatactgaagcgttttataaaataagcacactgtactaccaactaggagaccacgaactgtccctcagtgaagttcgggaatgtcttaaacttgaccaggatcataaaaggtgttttgcacactataaacaagtaaagaaacttaataagctgattgagtcagctgaagagctcatcagagatggcagatacacagatgctaccagcaaatatgaatctgtcatgaaaacagagccaagcattgctgaatatacagttcgttcaaaggagaggatttgccactgcttttctaaggacgagaagcctgttgaagctattagggtttgttctgaagttttacagatggaacctgacaatgtgaatgccctgaaagatcgagcagaggcctatttgatagaggaaatgtatgatgaagctattcaggattatgaaactgctcaggaacacaatgaaaatgatcagcagattcgagaaggtctagagaaagcacaaagattattgaaacagtcgcagaaacgagattattataaaatcttgggagtaaaaagaaatgccaaaaagcaagaaattattaaagcataccgaaaattagcactgcagtggcacccagataacttccagaatgaagaagaaaagaaaaaagctgagaaaaagttcattgatatagcagctgctaaagaagtcctctctgatccagaaatgagaaagaagtttgacgacggagaagatcctttggatgcagagagccagcaaggaggcggcggcaaccctttccacagaagctggaactcatggcaagggttcaatcccttcagctcaggcggaccatttagatttaaattccacttcaattaaaccaactgtttttctgctcttcttaatttttttaaagattaaaaacaaagaaatcttgttccgggaccctaatgaaaaaaaatttcaaatcttttcagtttgtccatgaccaaagagttgctttaataggaaaaaatctgttcttatccctgtcagatttatggttaatgggtttgcaacggcaaggaggcaaggaatggttctatttctgacagagcagcctgcatctgctttatgctgtctggagggaagtggtctgaggcaggctcacccgtggaagtgctcacgtattctgtattatttttctacactggagctgagattcttctcttcacagccttgcagagtaagtcagtgcctacaagtgtaagaaggagctgtaatcttcatgaggatggttatacttcagtattcttaaagagaacatgaacatttttgagctgtatgttcttagggacaactgtgcttcgatgtggtcagtctcgtcacttgtgagtagctgtgaaatctttagtgtgcatgtgtttgcacctctgtggtctgtcaacgtggctgtcactgaaggagcaagagaccatcttttaggaaccctgccaccaaataataatatatccaggcttagactttggattaatgttaaatgtacatttttttggttcagtacctgaagaagaatactgaaacttgaatctataaattcctatggacccttttaatattaaacacaacaaattaaaagttgttataggtaaaataagttcagataaaatagtggtggtatttaaaataatattgctgaagtgcagattgaaatactttttaaacaactgaagttctgagtttttatagggaatttcatgtaacaagactggtttagaaacgtaaagttgcgcagtcaacataaataaatacagaatgccatgttnnccacttctaagtaaagacagtgggcagcttctgtttctccttctatcaaggcttcaccctatcttaaaggtctgtggtgcctcccacgtgggacctgtctgctggtatgtgttaaacagcagaccggcccttctaccagatcttgatgcctctgattttctcctgcctacaagaaaatacaggcaaggttagtcaggtctggctatatttccactgttgtttcatttaataagatggcatctcctcttgagatatgttcttcttaccttttaagaagatactatttaagaagtgaactattcagtctttgtatactgaatgctttttccctaaaaaatgttaatcaagaatattgaatatttatggcactcttgatgctgcatttgaaagctgaaggaattactttagatagataggaattgctacctttattctggaaaggttttgtttctgcctcaaagcattttgaagtgttttaaccattaaagggtctaatttttttttcttaatgaaatcaagcattttaattcactgtgggaggcatcctgaccacggacatccataacagcaaagcacaaatcgttttcgtctgtagtcatatcctgaaacataggtggacaaatttttaactgagagacaaaaatcacatagttgaattgagcagaacacttaagtgctttctgcatctatttaggagtctatttcttaccaataaacttgacaacgcatttggaaaactagtgaacaccttacagctttcattttgctttaatgtttcaattcaagccggtgtaaaaataatttccaaggcatttctgtttattctttagtaatctcactactggctatgtcagcaatatctttttcaatctggttccttttgtatatgatgtcactgtgacctctttgaaatatagtgatggcttttacctactttgaaaagaattttcacatagagtcagaaaaaaaaggaaatatcaaatcacttgcctttccacttggagagcacgacagttgccaacaacaaggggtcaagggccgcacaggagatgtgtgggggcctggccacctcccacctgctgcccagaggcttgtttgcattttcattttttctccacttgtaacaaccatagtttcagctcctaaattcttatcatggatttacttagtcatcttaactgacctgcagttacttgcctgttttcagtgaagagagagaagcagctctggtgccacatgccagtgccatggagggaaatgaattctctgcaatctgttgtttcgctgattcatgaagaaagtaacaactgttgagtttcagccttgatggctgtcggcagttttctggtgtccacccaaacggagagacagtcactcctgcttaccctaatgtgtgactgagaagcagcctgggtgtgtaaagagatagtcattccccctgcctgtctcactgtagggtagcattatccactgtaaaaccatactactttcattttcccttggggactacaggtgccaggtaaccttttttttttttttttttttttttgagacagaatcttgctctgttgcccaggctggagtgcagggacacctcccgggttcaagcagttctcctgcctcagcctccaagtagctgggactataggcacgcaccaccatgcctggctaatttttgtatttttagtagaaatggggtttcactgtgttagccaggatggtcttgatctcctgaccttgtgatctgcccgccttggccttccaaagtgttgggattacaggcgtgagccactgcgcctggccatcaggtaacctttatggctctttcaggaaaagtgaaatcagagaggcgtaccctagccacagctgttgtattctgctcttctttcctttttggtgagcttcatgggtggagttatcagtggtctgtactttgtggatattttgcccagcaggaagtattagacacatcagtctagaagcattgtgaaaaggttccaaaacgggagacaaaatttaattcattcctcagttctgaaagtttgtgctttcttaccatgaatagatgaaaacttgaaaaaaatcttgacagtttactaatgtgaatcagatgtaacgtactactaattctacaatgcctttctctttagtcagtattaaaaatcttttttaaagtattggtatgaaaacaaatttttgttgccctgataatggaattttaaaactacccacagtttaagagaaaacataacttggtaaaaaaggtagccaataaaaccacaatttgaaattgataccattttctactcacaatggatgatgaaaaatttcacctttaaatgggtcagaagttgtctttgacatttaccatgaaaaaactacataaaatggctccctggtgaggttacagacacggccctggtgatgggcgttgcaaagttttcactgagcacacagcaatggtatcacctagagaagttcacgcaactttgttgaatgtagttgacttttccaaatttataaaggaaggaagaaggcaaatgttaatttgccaacaacgaatatcctttttctaaatcagatcattccttttttgttagtggcagtttatcctgtaatttcaaatgacgttaagaggtgggattatttgggggttttttttgtttgtttacagatgatctcatttgctgaatgattgatttaagagtaaaattagccactgcgtggctttgtgtatagtaaccggttttgttgcacttgtctgtggctgaaacacttacctgcagtggaaagccgagcaaggaggaggtaaacattggagatgtttgtgaaaatattactcttgctgtgaggttttagtttgttttgaatgagaaaagactaagtaacttaatccatctcaatgtagtgttttaataaaaaaggaacctaatatttgaaatgggtctcagacatgtctacaaatatgggtactatttttatgcccgtgtattttcacatttaataaaaatatttatggtcatatcagta

SEQ ID NO: 285538 - DNA, 5872 bp, Homo sapiens
  misc_feature (2841)..(2842): n is a, c, g, or t
gcggccgccaccgactccccgtctgcttccctccgggcggcagccgcggtttggagcttgctgacagctctgcgaccggcgggcgcagcctcgtctcgtgcttccacgttatcctatcagggacggggcggggcggcggcctccgcagcctatcagcgcgaaccacgaccccggcgagcccgggaggaaagccgccagaaagaaggcgattggatggcggcggcgctctggggcgtagcgtcgcccgggccccgcccaccgctgccttcctctgctgggctccagagccactgaggcctgagcgagagccgacggcgggcgggcgcagctgctgccggagcgccggcgcgtgctggtgggccacacacctttcctcctcttcactcgcgagccctcggacatggtggcccccggctccgtgaccagccggctgggctcggtattccccttcctgctagtcctggtggatctgcagtacgaaggtgctgaatgtggagtaaatgcagatgttgagaaacatcttgaattgggcaagaaattacttgcagctggacagctagctgatgctttatctcagtttcatgctgccgtagatggtgaccctgataactatattgcttattatcggagggctactgtctttttagctatgggcaaatcaaaagctgcacttcctgatttaactaaagtgattcaattgaagatggacttcactgcagcaagattacagagaggtcacttattactcaaacaaggaaaacttgatgaagcagaagatgattttaaaaaagtgctcaaatctaatccaagtgaaaatgaagaaaaggaagcacagtctcaacttataaaatctgatgaaatgcagcgtttgcgttcacaagcacttaacgcttttggaagtggagattatactgctgctatagccttccttgataagattttagaggtttgtgtttgggatgcagaactacgggaacttcgagctgaatgttttataaaagaaggagaacctaggaaagctataagtgacttaaaagctgcgtcaaagttgaagaatgataatactgaagcgttttataaaataagcacactgtactaccaactaggagaccacgaactgtccctcagtgaagttcgggaatgtcttaaacttgaccaggatcataaaaggtgttttgcacactataaacaagtaaagaaacttaataagctgattgagtcagctgaagagctcatcagagatggcagatacacagatgctaccagcaaatatgaatctgtcatgaaaacagagccaagcattgctgaatatacagttcgttcaaaggagaggatttgccactgcttttctaaggacgagaagcctgttgaagctattagggtttgttctgaagttttacagatggaacctgacaatgtgaatgccctgaaagatcgagcagaggcctatttgatagaggaaatgtatgatgaagctattcaggattatgaaactgctcaggaacacaatgaaaatgatcagcagattcgagaaggtctagagaaagcacaaagattattgaaacagtcgcagaaacgagattattataaaatcttgggagtaaaaagaaatgccaaaaagcaagaaattattaaagcataccgaaaattagcactgcagtggcacccagataacttccagaatgaagaagaaaagaaaaaagctgagaaaaagttcattgatatagcagctgctaaagaagtcctctctgatccagaaatgagaaagaagtttgacgacggagaagatcctttggatgcagagagccagcaaggaggcggcggcaaccctttccacagaagctggaactcatggcaagggttcaatcccttcagctcaggcggaccatttagatttaaattccacttcaattaaaccaactgtttttctgctcttcttaatttttttaaagattaaaaacaaagaaatcttgttccgggaccctaatgaaaaaaaatttcaaatcttttcagtttgtccatgaccaaagagttgctttaataggaaaaaatctgttcttatccctgtcagatttatggttaatgggtttgcaacggcaaggaggcaaggaatggttctatttctgacagagcagcctgcatctgctttatgctgtctggagggaagtggtctgaggcaggctcacccgtggaagtgctcacgtattctgtattatttttctacactggagctgagattcttctcttcacagccttgcagagtaagtcagtgcctacaagtgtaagaaggagctgtaatcttcatgaggatggttatacttcagtattcttaaagagaacatgaacatttttgagctgtatgttcttagggacaactgtgcttcgatgtggtcagtctcgtcacttgtgagtagctgtgaaatctttagtgtgcatgtgtttgcacctctgtggtctgtcaacgtggctgtcactgaaggagcaagagaccatcttttaggaaccctgccaccaaataataatatatccaggcttagactttggattaatgttaaatgtacatttttttggttcagtacctgaagaagaatactgaaacttgaatctataaattcctatggacccttttaatattaaacacaacaaattaaaagttgttataggtaaaataagttcagataaaatagtggtggtatttaaaataatattgctgaagtgcagattgaaatactttttaaacaactgaagttctgagtttttatagggaatttcatgtaacaagactggtttagaaacgtaaagttgcgcagtcaacataaataaatacagaatgccatgttnnccacttctaagtaaagacagtgggcagcttctgtttctccttctatcaaggcttcaccctatcttaaaggtctgtggtgcctcccacgtgggacctgtctgctggtatgtgttaaacagcagaccggcccttctaccagatcttgatgcctctgattttctcctgcctacaagaaaatacaggcaaggttagtcaggtctggctatatttccactgttgtttcatttaataagatggcatctcctcttgagatatgttcttcttaccttttaagaagatactatttaagaagtgaactattcagtctttgtatactgaatgctttttccctaaaaaatgttaatcaagaatattgaatatttatggcactcttgatgctgcatttgaaagctgaaggaattactttagatagataggaattgctacctttattctggaaaggttttgtttctgcctcaaagcattttgaagtgttttaaccattaaagggtctaatttttttttcttaatgaaatcaagcattttaattcactgtgggaggcatcctgaccacggacatccataacagcaaagcacaaatcgttttcgtctgtagtcatatcctgaaacataggtggacaaatttttaactgagagacaaaaatcacatagttgaattgagcagaacacttaagtgctttctgcatctatttaggagtctatttcttaccaataaacttgacaacgcatttggaaaactagtgaacaccttacagctttcattttgctttaatgtttcaattcaagccggtgtaaaaataatttccaaggcatttctgtttattctttagtaatctcactactggctatgtcagcaatatctttttcaatctggttccttttgtatatgatgtcactgtgacctctttgaaatatagtgatggcttttacctactttgaaaagaattttcacatagagtcagaaaaaaaaggaaatatcaaatcacttgcctttccacttggagagcacgacagttgccaacaacaaggggtcaagggccgcacaggagatgtgtgggggcctggccacctcccacctgctgcccagaggcttgtttgcattttcattttttctccacttgtaacaaccatagtttcagctcctaaattcttatcatggatttacttagtcatcttaactgacctgcagttacttgcctgttttcagtgaagagagagaagcagctctggtgccacatgccagtgccatggagggaaatgaattctctgcaatctgttgtttcgctgattcatgaagaaagtaacaactgttgagtttcagccttgatggctgtcggcagttttctggtgtccacccaaacggagagacagtcactcctgcttaccctaatgtgtgactgagaagcagcctgggtgtgtaaagagatagtcattccccctgcctgtctcactgtagggtagcattatccactgtaaaaccatactactttcattttcccttggggactacaggtgccaggtaaccttttttttttttttttttttttttgagacagaatcttgctctgttgcccaggctggagtgcagggacacctcccgggttcaagcagttctcctgcctcagcctccaagtagctgggactataggcacgcaccaccatgcctggctaatttttgtatttttagtagaaatggggtttcactgtgttagccaggatggtcttgatctcctgaccttgtgatctgcccgccttggccttccaaagtgttgggattacaggcgtgagccactgcgcctggccatcaggtaacctttatggctctttcaggaaaagtgaaatcagagaggcgtaccctagccacagctgttgtattctgctcttctttcctttttggtgagcttcatgggtggagttatcagtggtctgtactttgtggatattttgcccagcaggaagtattagacacatcagtctagaagcattgtgaaaaggttccaaaacgggagacaaaatttaattcattcctcagttctgaaagtttgtgctttcttaccatgaatagatgaaaacttgaaaaaaatcttgacagtttactaatgtgaatcagatgtaacgtactactaattctacaatgcctttctctttagtcagtattaaaaatcttttttaaagtattggtatgaaaacaaatttttgttgccctgataatggaattttaaaactacccacagtttaagagaaaacataacttggtaaaaaaggtagccaataaaaccacaatttgaaattgataccattttctactcacaatggatgatgaaaaatttcacctttaaatgggtcagaagttgtctttgacatttaccatgaaaaaactacataaaatggctccctggtgaggttacagacacggccctggtgatgggcgttgcaaagttttcactgagcacacagcaatggtatcacctagagaagttcacgcaactttgttgaatgtagttgacttttccaaatttataaaggaaggaagaaggcaaatgttaatttgccaacaacgaatatcctttttctaaatcagatcattccttttttgttagtggcagtttatcctgtaatttcaaatgacgttaagaggtgggattatttgggggttttttttgtttgtttacagatgatctcatttgctgaatgattgatttaagagtaaaattagccactgcgtggctttgtgtatagtaaccggttttgttgcacttgtctgtggctgaaacacttacctgcagtggaaagccgagcaaggaggaggtaaacattggagatgtttgtgaaaatattactcttgctgtgaggttttagtttgttttgaatgagaaaagactaagtaacttaatccatctcaatgtagtgttttaataaaaaaggaacctaatatttgaaatgggtctcagacatgtctacaaatatgggtactatttttatgcccgtgtattttcacatttaataaaaatatttatggtcatatcagta

SEQ ID NO: 285539 - DNA, 5601 bp, Homo sapiens
  misc_feature (24)..(24): n is a, c, g, or t
  misc_feature (27)..(27): n is a, c, g, or t
  misc_feature (37)..(38): n is a, c, g, or t
  misc_feature (64)..(65): n is a, c, g, or t
  misc_feature (69)..(71): n is a, c, g, or t
  misc_feature (73)..(73): n is a, c, g, or t
  misc_feature (169)..(169): n is a, c, g, or t
  misc_feature (181)..(181): n is a, c, g, or t
  misc_feature (199)..(199): n is a, c, g, or t
  misc_feature (219)..(219): n is a, c, g, or t
  misc_feature (230)..(230): n is a, c, g, or t
  misc_feature (243)..(243): n is a, c, g, or t
  misc_feature (429)..(429): n is a, c, g, or t
  misc_feature (2570)..(2571): n is a, c, g, or t
gctcggtacccctttttctgtctnagntggtttcatnnaatgcagcacttggttagcagatgtnnaatnnntntttcttaatgaaatcaagcattctaattcactgtgggaggcatcctgaccacggacatccataacagctaagcacaaatcgttttcgtctgtagtnatatcctgaaanataggtggacaaattttnaactgagagacaaaaatcanatagttgaatngagcagaacactnaagtgctttctgcatctatttaggagtctatttcttaccaataaacttgacaacgcatttggaaaactagtgacaccttacagctttcatttgtgctttaatgtttcaattcaagccggtgtaaaaataatttccaaggcatttctgtttattctttagtaatctcactactggctatgtcagcantatctttttcaatctggcgcaagattacagagaggtcacttattactcaaacaaggaaaacttgatgaagcagaagatgattttaaaaaagtgctcaaatctaatccaagtgaaaatgaagaaaaggaagcacagtctcaacttataaaatctgatgaaatgcagcgtttgcgttcacaagcacttaacgcttttggaagtggagattatactgctgctatagccttccttgataagattttagaggtttgtgtttgggatgcagaactacgggaacttcgagctgaatgttttataaaagaaggagaacctaggaaagctataagtgacttaaaagctgcgtcaaagttgaagaatgataatactgaagcgttttataaaataagcacactgtactaccaactaggagaccacgaactgtccctcagtgaagttcgggaatgtcttaaacttgaccaggatcataaaaggtgttttgcacactataaacaagtaaagaaacttaataagctgattgagtcagctgaagagctcatcagagatggcagatacacagatgctaccagcaaatatgaatctgtcatgaaaacagagccaagcattgctgaatatacagttcgttcaaaggagaggatttgccactgcttttctaaggacgagaagcctgttgaagctattagggtttgttctgaagttttacagatggaacctgacaatgtgaatgccctgaaagatcgagcagaggcctatttgatagaggaaatgtatgatgaagctattcaggattatgaaactgctcaggaacacaatgaaaatgatcagcagattcgagaaggtctagagaaagcacaaagattattgaaacagtcgcagaaacgagattattataaaatcttgggagtaaaaagaaatgccaaaaagcaagaaattattaaagcataccgaaaattagcactgcagtggcacccagataacttccagaatgaagaagaaaagaaaaaagctgagaaaaagttcattgatatagcagctgctaaagaagtcctctctgatccagaaatgagaaagaagtttgacgacggagaagatcctttggatgcagagagccagcaaggaggcggcggcaaccctttccacagaagctggaactcatggcaagggttcaatcccttcagctcaggcggaccatttagatttaaattccacttcaattaaaccaactgtttttctgctcttcttaatttttttaaagattaaaaacaaagaaatcttgttccgggaccctaatgaaaaaaaatttcaaatcttttcagtttgtccatgaccaaagagttgctttaataggaaaaaatctgttcttatccctgtcagatttatggttaatgggtttgcaacggcaaggaggcaaggaatggttctatttctgacagagcagcctgcatctgctttatgctgtctggagggaagtggtctgaggcaggctcacccgtggaagtgctcacgtattctgtattatttttctacactggagctgagattcttctcttcacagccttgcagagtaagtcagtgcctacaagtgtaagaaggagctgtaatcttcatgaggatggttatacttcagtattcttaaagagaacatgaacatttttgagctgtatgttcttagggacaactgtgcttcgatgtggtcagtctcgtcacttgtgagtagctgtgaaatctttagtgtgcatgtgtttgcacctctgtggtctgtcaacgtggctgtcactgaaggagcaagagaccatcttttaggaaccctgccaccaaataataatatatccaggcttagactttggattaatgttaaatgtacatttttttggttcagtacctgaagaagaatactgaaacttgaatctataaattcctatggacccttttaatattaaacacaacaaattaaaagttgttataggtaaaataagttcagataaaatagtggtggtatttaaaataatattgctgaagtgcagattgaaatactttttaaacaactgaagttctgagtttttatagggaatttcatgtaacaagactggtttagaaacgtaaagttgcgcagtcaacataaataaatacagaatgccatgttnnccacttctaagtaaagacagtgggcagcttctgtttctccttctatcaaggcttcaccctatcttaaaggtctgtggtgcctcccacgtgggacctgtctgctggtatgtgttaaacagcagaccggcccttctaccagatcttgatgcctctgattttctcctgcctacaagaaaatacaggcaaggttagtcaggtctggctatatttccactgttgtttcatttaataagatggcatctcctcttgagatatgttcttcttaccttttaagaagatactatttaagaagtgaactattcagtctttgtatactgaatgctttttccctaaaaaatgttaatcaagaatattgaatatttatggcactcttgatgctgcatttgaaagctgaaggaattactttagatagataggaattgctacctttattctggaaaggttttgtttctgcctcaaagcattttgaagtgttttaaccattaaagggtctaatttttttttcttaatgaaatcaagcattttaattcactgtgggaggcatcctgaccacggacatccataacagcaaagcacaaatcgttttcgtctgtagtcatatcctgaaacataggtggacaaatttttaactgagagacaaaaatcacatagttgaattgagcagaacacttaagtgctttctgcatctatttaggagtctatttcttaccaataaacttgacaacgcatttggaaaactagtgaacaccttacagctttcattttgctttaatgtttcaattcaagccggtgtaaaaataatttccaaggcatttctgtttattctttagtaatctcactactggctatgtcagcaatatctttttcaatctggttccttttgtatatgatgtcactgtgacctctttgaaatatagtgatggcttttacctactttgaaaagaattttcacatagagtcagaaaaaaaaggaaatatcaaatcacttgcctttccacttggagagcacgacagttgccaacaacaaggggtcaagggccgcacaggagatgtgtgggggcctggccacctcccacctgctgcccagaggcttgtttgcattttcattttttctccacttgtaacaaccatagtttcagctcctaaattcttatcatggatttacttagtcatcttaactgacctgcagttacttgcctgttttcagtgaagagagagaagcagctctggtgccacatgccagtgccatggagggaaatgaattctctgcaatctgttgtttcgctgattcatgaagaaagtaacaactgttgagtttcagccttgatggctgtcggcagttttctggtgtccacccaaacggagagacagtcactcctgcttaccctaatgtgtgactgagaagcagcctgggtgtgtaaagagatagtcattccccctgcctgtctcactgtagggtagcattatccactgtaaaaccatactactttcattttcccttggggactacaggtgccaggtaaccttttttttttttttttttttttttgagacagaatcttgctctgttgcccaggctggagtgcagggacacctcccgggttcaagcagttctcctgcctcagcctccaagtagctgggactataggcacgcaccaccatgcctggctaatttttgtatttttagtagaaatggggtttcactgtgttagccaggatggtcttgatctcctgaccttgtgatctgcccgccttggccttccaaagtgttgggattacaggcgtgagccactgcgcctggccatcaggtaacctttatggctctttcaggaaaagtgaaatcagagaggcgtaccctagccacagctgttgtattctgctcttctttcctttttggtgagcttcatgggtggagttatcagtggtctgtactttgtggatattttgcccagcaggaagtattagacacatcagtctagaagcattgtgaaaaggttccaaaacgggagacaaaatttaattcattcctcagttctgaaagtttgtgctttcttaccatgaatagatgaaaacttgaaaaaaatcttgacagtttactaatgtgaatcagatgtaacgtactactaattctacaatgcctttctctttagtcagtattaaaaatcttttttaaagtattggtatgaaaacaaatttttgttgccctgataatggaattttaaaactacccacagtttaagagaaaacataacttggtaaaaaaggtagccaataaaaccacaatttgaaattgataccattttctactcacaatggatgatgaaaaatttcacctttaaatgggtcagaagttgtctttgacatttaccatgaaaaaactacataaaatggctccctggtgaggttacagacacggccctggtgatgggcgttgcaaagttttcactgagcacacagcaatggtatcacctagagaagttcacgcaactttgttgaatgtagttgacttttccaaatttataaaggaaggaagaaggcaaatgttaatttgccaacaacgaatatcctttttctaaatcagatcattccttttttgttagtggcagtttatcctgtaatttcaaatgacgttaagaggtgggattatttgggggttttttttgtttgtttacagatgatctcatttgctgaatgattgatttaagagtaaaattagccactgcgtggctttgtgtatagtaaccggttttgttgcacttgtctgtggctgaaacacttacctgcagtggaaagccgagcaaggaggaggtaaacattggagatgtttgtgaaaatattactcttgctgtgaggttttagtttgttttgaatgagaaaagactaagtaacttaatccatctcaatgtagtgttttaataaaaaaggaacctaatatttgaaatgggtctcagacatgtctacaaatatgggtactatttttatgcccgtgtattttcacatttaataaaaatatttatggtcatatcagta

SEQ ID NO: 285540 - DNA, 4634 bp, Homo sapiens
  misc_feature (1603)..(1604): n is a, c, g, or t
ctacaatgtgtgaaatgttgtctaccagggaagctcgttatagacactgcacccagagtttttttggggaactagtcactagacacgttctgtctggcctgcaccaaaatcccagactcccagaaggaaagatgtttaccataaactgtatttttcatacaaacagttcaggcatgagtcattcttaccatggaatgttgggaacactcctgaaatctggcttcccaaacgtcagcactattcaggattatgaaactgctcaggaacacaatgaaaatgatcagcagattcgagaaggtctagagaaagcacaaagattattgaaacagtcgcagaaacgagattattataaaatcttgggagtaaaaagaaatgccaaaaagcaagaaattattaaagcataccgaaaattagcactgcagtggcacccagataacttccagaatgaagaagaaaagaaaaaagctgagaaaaagttcattgatatagcagctgctaaagaagtcctctctgatccagaaatgagaaagaagtttgacgacggagaagatcctttggatgcagagagccagcaaggaggcggcggcaaccctttccacagaagctggaactcatggcaagggttcaatcccttcagctcaggcggaccatttagatttaaattccacttcaattaaaccaactgtttttctgctcttcttaatttttttaaagattaaaaacaaagaaatcttgttccgggaccctaatgaaaaaaaatttcaaatcttttcagtttgtccatgaccaaagagttgctttaataggaaaaaatctgttcttatccctgtcagatttatggttaatgggtttgcaacggcaaggaggcaaggaatggttctatttctgacagagcagcctgcatctgctttatgctgtctggagggaagtggtctgaggcaggctcacccgtggaagtgctcacgtattctgtattatttttctacactggagctgagattcttctcttcacagccttgcagagtaagtcagtgcctacaagtgtaagaaggagctgtaatcttcatgaggatggttatacttcagtattcttaaagagaacatgaacatttttgagctgtatgttcttagggacaactgtgcttcgatgtggtcagtctcgtcacttgtgagtagctgtgaaatctttagtgtgcatgtgtttgcacctctgtggtctgtcaacgtggctgtcactgaaggagcaagagaccatcttttaggaaccctgccaccaaataataatatatccaggcttagactttggattaatgttaaatgtacatttttttggttcagtacctgaagaagaatactgaaacttgaatctataaattcctatggacccttttaatattaaacacaacaaattaaaagttgttataggtaaaataagttcagataaaatagtggtggtatttaaaataatattgctgaagtgcagattgaaatactttttaaacaactgaagttctgagtttttatagggaatttcatgtaacaagactggtttagaaacgtaaagttgcgcagtcaacataaataaatacagaatgccatgttnnccacttctaagtaaagacagtgggcagcttctgtttctccttctatcaaggcttcaccctatcttaaaggtctgtggtgcctcccacgtgggacctgtctgctggtatgtgttaaacagcagaccggcccttctaccagatcttgatgcctctgattttctcctgcctacaagaaaatacaggcaaggttagtcaggtctggctatatttccactgttgtttcatttaataagatggcatctcctcttgagatatgttcttcttaccttttaagaagatactatttaagaagtgaactattcagtctttgtatactgaatgctttttccctaaaaaatgttaatcaagaatattgaatatttatggcactcttgatgctgcatttgaaagctgaaggaattactttagatagataggaattgctacctttattctggaaaggttttgtttctgcctcaaagcattttgaagtgttttaaccattaaagggtctaatttttttttcttaatgaaatcaagcattttaattcactgtgggaggcatcctgaccacggacatccataacagcaaagcacaaatcgttttcgtctgtagtcatatcctgaaacataggtggacaaatttttaactgagagacaaaaatcacatagttgaattgagcagaacacttaagtgctttctgcatctatttaggagtctatttcttaccaataaacttgacaacgcatttggaaaactagtgaacaccttacagctttcattttgctttaatgtttcaattcaagccggtgtaaaaataatttccaaggcatttctgtttattctttagtaatctcactactggctatgtcagcaatatctttttcaatctggttccttttgtatatgatgtcactgtgacctctttgaaatatagtgatggcttttacctactttgaaaagaattttcacatagagtcagaaaaaaaaggaaatatcaaatcacttgcctttccacttggagagcacgacagttgccaacaacaaggggtcaagggccgcacaggagatgtgtgggggcctggccacctcccacctgctgcccagaggcttgtttgcattttcattttttctccacttgtaacaaccatagtttcagctcctaaattcttatcatggatttacttagtcatcttaactgacctgcagttacttgcctgttttcagtgaagagagagaagcagctctggtgccacatgccagtgccatggagggaaatgaattctctgcaatctgttgtttcgctgattcatgaagaaagtaacaactgttgagtttcagccttgatggctgtcggcagttttctggtgtccacccaaacggagagacagtcactcctgcttaccctaatgtgtgactgagaagcagcctgggtgtgtaaagagatagtcattccccctgcctgtctcactgtagggtagcattatccactgtaaaaccatactactttcattttcccttggggactacaggtgccaggtaaccttttttttttttttttttttttttgagacagaatcttgctctgttgcccaggctggagtgcagggacacctcccgggttcaagcagttctcctgcctcagcctccaagtagctgggactataggcacgcaccaccatgcctggctaatttttgtatttttagtagaaatggggtttcactgtgttagccaggatggtcttgatctcctgaccttgtgatctgcccgccttggccttccaaagtgttgggattacaggcgtgagccactgcgcctggccatcaggtaacctttatggctctttcaggaaaagtgaaatcagagaggcgtaccctagccacagctgttgtattctgctcttctttcctttttggtgagcttcatgggtggagttatcagtggtctgtactttgtggatattttgcccagcaggaagtattagacacatcagtctagaagcattgtgaaaaggttccaaaacgggagacaaaatttaattcattcctcagttctgaaagtttgtgctttcttaccatgaatagatgaaaacttgaaaaaaatcttgacagtttactaatgtgaatcagatgtaacgtactactaattctacaatgcctttctctttagtcagtattaaaaatcttttttaaagtattggtatgaaaacaaatttttgttgccctgataatggaattttaaaactacccacagtttaagagaaaacataacttggtaaaaaaggtagccaataaaaccacaatttgaaattgataccattttctactcacaatggatgatgaaaaatttcacctttaaatgggtcagaagttgtctttgacatttaccatgaaaaaactacataaaatggctccctggtgaggttacagacacggccctggtgatgggcgttgcaaagttttcactgagcacacagcaatggtatcacctagagaagttcacgcaactttgttgaatgtagttgacttttccaaatttataaaggaaggaagaaggcaaatgttaatttgccaacaacgaatatcctttttctaaatcagatcattccttttttgttagtggcagtttatcctgtaatttcaaatgacgttaagaggtgggattatttgggggttttttttgtttgtttacagatgatctcatttgctgaatgattgatttaagagtaaaattagccactgcgtggctttgtgtatagtaaccggttttgttgcacttgtctgtggctgaaacacttacctgcagtggaaagccgagcaaggaggaggtaaacattggagatgtttgtgaaaatattactcttgctgtgaggttttagtttgttttgaatgagaaaagactaagtaacttaatccatctcaatgtagtgttttaataaaaaaggaacctaatatttgaaatgggtctcagacatgtctacaaatatgggtactatttttatgcccgtgtattttcacatttaataaaaatatttatggtcatatcagta

SEQ ID NO: 285541 - DNA, 6536 bp, Homo sapiens
  misc_feature (3132)..(3133): n is a, c, g, or t
aaattattcacaaaaagcagctggaaatcagaaaggcagctgccgctccagggtctcaaatccattaaaaccaccacagaacaattaaaacaatcagagagagaaaaggaaaaggaaacaacgtccaacatttggcatttggttttatccacaggttttcccagagctcctcttggaattgaaagcaaaatatattggcaaacactgcttctcaatacacaggaaggggagcctcagtgcctcctgccaacagaggcggctctgtgcagtcagactgtggggtgcacagcagtctctcaggctggggtttctggcctctttccatccaatcaccccttccaggaaattcagcagcctaccagacactgggcctctgcctggctgccctttcccccaggcagagcggccttgggcataataccaggcaacctgccagccccagagcagaaaccctgctgggatcccttccttcatcaaccttggtgtggaggatgctcaatagcgcttccacctccccctccccagcccctagctacatctctccacccttccctggacagtcctacttcccagctcacccacccaccagcagcttaagtctgggtgggatctatcatcagctcctccccctgtaacctcttccctccacagatccaccctgtgactcctcttcactcgcgagccctcggacatggtggcccccggctccgtgaccagccggctgggctcggtattccccttcctgctagtcctggtggatctgcagtacgaaggtgctgaatgtggagtaaatgcagatgttgagaaacatcttgaattgggcaagaaattacttgcagctggacagctagctgatgctttatctcagtttcatgctgccgtagatggtgaccctgataactatattgcttattatcggagggctactgtctttttagctatgggcaaatcaaaagctgcacttcctgatttaactaaagtgattcaattgaagatggacttcactgcagcaagattacagagaggtcacttattactcaaacaaggaaaacttgatgaagcagaagatgattttaaaaaagtgctcaaatctaatccaagtgaaaatgaagaaaaggaagcacagtctcaacttataaaatctgatgaaatgcagcgtttgcgttcacaagcacttaacgcttttggaagtggagattatactgctgctatagccttccttgataagattttagaggtttgtgtttgggatgcagaactacgggaacttcgagctgaatgttttataaaagaaggagaacctaggaaagctataagtgacttaaaagctgcgtcaaagttgaagaatgataatactgaagcgttttataaaataagcacactgtactaccaactaggagaccacgaactgtccctcagtgaagttcgggaatgtcttaaacttgaccaggatcataaaaggtgttttgcacactataaacaagtaaagaaacttaataagctgattgagtcagctgaagagctcatcagagatggcagatacacagatgctaccagcaaatatgaatctgtcatgaaaacagagccaagcattgctgaatatacagttcgttcaaaggagaggatttgccactgcttttctaaggacgagaagcctgttgaagctattagggtttgttctgaagttttacagatggaacctgacaatgtgaatgccctgaaagatcgagcagaggcctatttgatagaggaaatgtatgatgaagctattcaggattatgaaactgctcaggaacacaatgaaaatgatcagcagattcgagaaggtctagagaaagcacaaagattattgaaacagtcgcagaaacgagattattataaaatcttgggagtaaaaagaaatgccaaaaagcaagaaattattaaagcataccgaaaattagcactgcagtggcacccagataacttccagaatgaagaagaaaagaaaaaagctgagaaaaagttcattgatatagcagctgctaaagaagtcctctctgatccagaaatgagaaagaagtttgacgacggagaagatcctttggatgcagagagccagcaaggaggcggcggcaaccctttccacagaagctggaactcatggcaagggttcaatcccttcagctcaggcggaccatttagatttaaattccacttcaattaaaccaactgtttttctgctcttcttaatttttttaaagattaaaaacaaagaaatcttgttccgggaccctaatgaaaaaaaatttcaaatcttttcagtttgtccatgaccaaagagttgctttaataggaaaaaatctgttcttatccctgtcagatttatggttaatgggtttgcaacggcaaggaggcaaggaatggttctatttctgacagagcagcctgcatctgctttatgctgtctggagggaagtggtctgaggcaggctcacccgtggaagtgctcacgtattctgtattatttttctacactggagctgagattcttctcttcacagccttgcagagtaagtcagtgcctacaagtgtaagaaggagctgtaatcttcatgaggatggttatacttcagtattcttaaagagaacatgaacatttttgagctgtatgttcttagggacaactgtgcttcgatgtggtcagtctcgtcacttgtgagtagctgtgaaatctttagtgtgcatgtgtttgcacctctgtggtctgtcaacgtggctgtcactgaaggagcaagagaccatcttttaggaaccctgccaccaaataataatatatccaggcttagactttggattaatgttaaatgtacatttttttggttcagtacctgaagaagaatactgaaacttgaatctataaattcctatggacccttttaatattaaacacaacaaattaaaagttgttataggtaaaataagttcagataaaatagtggtggtatttaaaataatattgctgaagtgcagattgaaatactttttaaacaactgaagttctgagtttttatagggaatttcatgtaacaagactggtttagaaacgtaaagttgcgcagtcaacataaataaatacagaatgccatgttnnccacttctaagtaaagacagtgggcagcttctgtttctccttctatcaaggcttcaccctatcttaaaggtctgtggtgcctcccacgtgggacctgtctgctggtatgtgttaaacagcagaccggcccttctaccagatcttgatgcctctgattttctcctgcctacaagaaaatacaggcaaggttagtcaggtctggctatatttccactgttgtttcatttaataagatggcatctcctcttgagatatgttcttcttaccttttaagaagatactatttaagaagtgaactattcagtctttgtatactgaatgctttttccctaaaaaatgttaatcaagaatattgaatatttatggcactcttgatgctgcatttgaaagctgaaggaattactttagatagataggaattgctacctttattctggaaaggttttgtttctgcctcaaagcattttgaagtgttttaaccattaaagggtctaatttttttttcttaatgaaatcaagcattttaattcactgtgggaggcatcctgaccacggacatccataacagcaaagcacaaatcgttttcgtctgtagtcatatcctgaaacataggtggacaaatttttaactgagagacaaaaatcacatagttgaattgagcagaacacttaagtgctttctgcatctatttaggagtctatttcttaccaataaacttgacaacgcatttggaaaactagtgaacaccttacagctttcattttgctttaatgtttcaattcaagccggtgtaaaaataatttccaaggcatttctgtttattctttagtaatctcactactggctatgtcagcaatatctttttcaatctggttccttttgtatatgatgtcactgtgacctctttgaaatatagtgatggcttttacctactttgaaaagaattttcacatagagtcagaaaaaaaaggaaatatcaaatcacttgcctttccacttggagagcacgacagttgccaacaacaaggggtcaagggccgcacaggagatgtgtgggggcctggccacctcccacctgctgcccagaggcttgtttgcattttcattttttctccacttgtaacaaccatagtttcagctcctaaattcttatcatggatttacttagtcatcttaactgacctgcagttacttgcctgttttcagtgaagagagagaagcagctctggtgccacatgccagtgccatggagggaaatgaattctctgcaatctgttgtttcgctgattcatgaagaaagtaacaactgttgagtttcagccttgatggctgtcggcagttttctggtgtccacccaaacggagagacagtcactcctgcttaccctaatgtgtgactgagaagcagcctgggtgtgtaaagagatagtcattccccctgcctgtctcactgtagggtagcattatccactgtaaaaccatactactttcattttcccttggggactacaggtgccaggtaaccttttttttttttttttttttttttgagacagaatcttgctctgttgcccaggctggagtgcagggacacctcccgggttcaagcagttctcctgcctcagcctccaagtagctgggactataggcacgcaccaccatgcctggctaatttttgtatttttagtagaaatggggtttcactgtgttagccaggatggtcttgatctcctgaccttgtgatctgcccgccttggccttccaaagtgttgggattacaggcgtgagccactgcgcctggccatcaggtaacctttatggctctttcaggaaaagtgaaatcagagaggcgtaccctagccacagctgttgtattctgctcttctttcctttttggtgagcttcatgggtggagttatcagtggtctgtactttgtggatattttgcccagcaggaagtattagacacatcagtctagaagcattgtgaaaaggttccaaaacgggagacaaaatttaattcattcctcagttctgaaagtttgtgctttcttaccatgaatagatgaaaacttgaaaaaaatcttgacagtttactaatgtgaatcagatgtaacgtactactaattctacaatgcctttctctttagtcagtattaaaaatcttttttaaagtattggtatgaaaacaaatttttgttgccctgataatggaattttaaaactacccacagtttaagagaaaacataacttggtaaaaaaggtagccaataaaaccacaatttgaaattgataccattttctactcacaatggatgatgaaaaatttcacctttaaatgggtcagaagttgtctttgacatttaccatgaaaaaactacataaaatggctccctggtgaggttacagacacggccctggtgatgggcgttgcaaagttttcactgagcacacagcaatggtatcacctagagaagttcacgcaactttgttgaatgtagttgacttttccaaatttataaaggaaggaagaaggcaaatgttaatttgccaacaacgaatatcctttttctaaatcagatcattccttttttgttagtggcagtttatcctgtaatttcaaatgacgttaagaggtgggattatttgggggttttttttgtttgtttacagatgatctcatttgctgaatgattgatttaagagtaaaattagccactgcgtggctttgtgtatagtaaccggttttgttgcacttgtctgtggctgaaacacttacctgcagtggaaagccgagcaaggaggaggtaaacattggagatgtttgtgaaaatattactcttgctgtgaggttttagtttgttttgaatgagaaaagactaagtaacttaatccatctcaatgtagtgttttaataaaaaaggaacctaatatttgaaatgggtctcagacatgtctacaaatatgggtactatttttatgcccgtgtattttcacatttaataaaaatatttatggtcatatcagtatttccttgcttttgattcatttttgtccttgagtataaaattctaagaaagtccgtcttaggaaaagtctattatttccagctttgcttcacgcaaaaccagtgactgaggtgacaaaagggctcttcctttacacaagttgacagggaaggtcagaacacacaaagcagaaagggctaaaataaaatctcttaaccctcaaaagtcctaggacaactaaggacttaaaaagtggacaagtcttccatttcagtgctattaaaatgtaacacttaaattggctttgtctgaagattttctcttctcttttataccccatttgtacatttctgttaaggtcctaagttgggaggaaggaaggacactatagcct

SEQ ID NO: 285542 - DNA, 4321 bp, Homo sapiens
  misc_feature (3132)..(3133): n is a, c, g, or t
aaattattcacaaaaagcagctggaaatcagaaaggcagctgccgctccagggtctcaaatccattaaaaccaccacagaacaattaaaacaatcagagagagaaaaggaaaaggaaacaacgtccaacatttggcatttggttttatccacaggttttcccagagctcctcttggaattgaaagcaaaatatattggcaaacactgcttctcaatacacaggaaggggagcctcagtgcctcctgccaacagaggcggctctgtgcagtcagactgtggggtgcacagcagtctctcaggctggggtttctggcctctttccatccaatcaccccttccaggaaattcagcagcctaccagacactgggcctctgcctggctgccctttcccccaggcagagcggccttgggcataataccaggcaacctgccagccccagagcagaaaccctgctgggatcccttccttcatcaaccttggtgtggaggatgctcaatagcgcttccacctccccctccccagcccctagctacatctctccacccttccctggacagtcctacttcccagctcacccacccaccagcagcttaagtctgggtgggatctatcatcagctcctccccctgtaacctcttccctccacagatccaccctgtgactcctcttcactcgcgagccctcggacatggtggcccccggctccgtgaccagccggctgggctcggtattccccttcctgctagtcctggtggatctgcagtacgaaggtgctgaatgtggagtaaatgcagatgttgagaaacatcttgaattgggcaagaaattacttgcagctggacagctagctgatgctttatctcagtttcatgctgccgtagatggtgaccctgataactatattgcttattatcggagggctactgtctttttagctatgggcaaatcaaaagctgcacttcctgatttaactaaagtgattcaattgaagatggacttcactgcagcaagattacagagaggtcacttattactcaaacaaggaaaacttgatgaagcagaagatgattttaaaaaagtgctcaaatctaatccaagtgaaaatgaagaaaaggaagcacagtctcaacttataaaatctgatgaaatgcagcgtttgcgttcacaagcacttaacgcttttggaagtggagattatactgctgctatagccttccttgataagattttagaggtttgtgtttgggatgcagaactacgggaacttcgagctgaatgttttataaaagaaggagaacctaggaaagctataagtgacttaaaagctgcgtcaaagttgaagaatgataatactgaagcgttttataaaataagcacactgtactaccaactaggagaccacgaactgtccctcagtgaagttcgggaatgtcttaaacttgaccaggatcataaaaggtgttttgcacactataaacaagtaaagaaacttaataagctgattgagtcagctgaagagctcatcagagatggcagatacacagatgctaccagcaaatatgaatctgtcatgaaaacagagccaagcattgctgaatatacagttcgttcaaaggagaggatttgccactgcttttctaaggacgagaagcctgttgaagctattagggtttgttctgaagttttacagatggaacctgacaatgtgaatgccctgaaagatcgagcagaggcctatttgatagaggaaatgtatgatgaagctattcaggattatgaaactgctcaggaacacaatgaaaatgatcagcagattcgagaaggtctagagaaagcacaaagattattgaaacagtcgcagaaacgagattattataaaatcttgggagtaaaaagaaatgccaaaaagcaagaaattattaaagcataccgaaaattagcactgcagtggcacccagataacttccagaatgaagaagaaaagaaaaaagctgagaaaaagttcattgatatagcagctgctaaagaagtcctctctgatccagaaatgagaaagaagtttgacgacggagaagatcctttggatgcagagagccagcaaggaggcggcggcaaccctttccacagaagctggaactcatggcaagggttcaatcccttcagctcaggcggaccatttagatttaaattccacttcaattaaaccaactgtttttctgctcttcttaatttttttaaagattaaaaacaaagaaatcttgttccgggaccctaatgaaaaaaaatttcaaatcttttcagtttgtccatgaccaaagagttgctttaataggaaaaaatctgttcttatccctgtcagatttatggttaatgggtttgcaacggcaaggaggcaaggaatggttctatttctgacagagcagcctgcatctgctttatgctgtctggagggaagtggtctgaggcaggctcacccgtggaagtgctcacgtattctgtattatttttctacactggagctgagattcttctcttcacagccttgcagagtaagtcagtgcctacaagtgtaagaaggagctgtaatcttcatgaggatggttatacttcagtattcttaaagagaacatgaacatttttgagctgtatgttcttagggacaactgtgcttcgatgtggtcagtctcgtcacttgtgagtagctgtgaaatctttagtgtgcatgtgtttgcacctctgtggtctgtcaacgtggctgtcactgaaggagcaagagaccatcttttaggaaccctgccaccaaataataatatatccaggcttagactttggattaatgttaaatgtacatttttttggttcagtacctgaagaagaatactgaaacttgaatctataaattcctatggacccttttaatattaaacacaacaaattaaaagttgttataggtaaaataagttcagataaaatagtggtggtatttaaaataatattgctgaagtgcagattgaaatactttttaaacaactgaagttctgagtttttatagggaatttcatgtaacaagactggtttagaaacgtaaagttgcgcagtcaacataaataaatacagaatgccatgttnnccacttctaagtaaagacagtgggcagcttctgtttctccttctatcaaggcttcaccctatcttaaaggtctgtggtgcctcccacgtgggacctgtctgctggtatgtgttaaacagcagaccggcccttctaccagatcttgatgcctctgattttctcctgcctacaagaaaatacaggcaaggttagtcaggtctggctatatttccactgttgtttcatttaataagatggcatctcctcttgagatatgttcttcttaccttttaagaagatactatttaagaagtgaactattcagtctttgtatactgaatgctttttccctaaaaaatgttaatcaagaatattgaatatttatggcactcttgatgctgcatttgaaagctgaaggaattactttagatagataggaattgctacctttattctggaaaggttttgtttctgcctcaaagcattttgaagtgttttaaccattaaagggtctaatttttttttcttaatgaaatcaagcattttaattcactgtgggaggcatcctgaccacggacatccataacagcaaagcacaaatcgttttcgtctgtagtcatatcctgaaacataggtggacaaatttttaactgagagacaaaaatcacatagttgaattgagcagaacacttaagtgctttctgcatctatttaggagtctatttcttaccaataaacttgacaacgcatttggaaaactagtgaacaccttacagctttcattttgctttaatgtttcaattcaagccggtgtaaaaataatttccaaggcatttctgtttattctttagtaatctcactactggctatgtcagcaatatctttttcaatctggttccttttgtatatgatgtcactgtgacctctttgaaatatagtgatggcttttacctactttgaaaagaattttcacatagagtcagaaaaaaaaggaaatatcaaatcacttgcctttccacttggagagcacgacagttgccaacaacaaggggtcaagggccgcacaggagatgtgtgggggcctggccacctcccacctgctgcccagaggcttgtttgcattttcattttttctccacttgtaacaacagattgcagagaattcatttccctccatggcactggcatgtggcaccagagctgtcgacg

SEQ ID NO: 285543 - DNA, 2748 bp, Homo sapiens
aaattattcacaaaaagcagctggaaatcagaaaggcagctgccgctccagggtctcaaatccattaaaaccaccacagaacaattaaaacaatcagagagagaaaaggaaaaggaaacaacgtccaacatttggcatttggttttatccacaggttttcccagagctcctcttggaattgaaagcaaaatatattggcaaacactgcttctcaatacacaggaaggggagcctcagtgcctcctgccaacagaggcggctctgtgcagtcagactgtggggtgcacagcagtctctcaggctggggtttctggcctctttccatccaatcaccccttccaggaaattcagcagcctaccagacactgggcctctgcctggctgccctttcccccaggcagagcggccttgggcataataccaggcaacctgccagccccagagcagaaaccctgctgggatcccttccttcatcaaccttggtgtggaggatgctcaatagcgcttccacctccccctccccagcccctagctacatctctccacccttccctggacagtcctacttcccagctcacccacccaccagcagcttaagtctgggtgggatctatcatcagctcctccccctgtaacctcttccctccacagatccaccctgtgactcctcttcactcgcgagccctcggacatggtggcccccggctccgtgaccagccggctgggctcggtattccccttcctgctagtcctggtggatctgcagtacgaaggtgctgaatgtggagtaaatgcagatgttgagaaacatcttgaattgggcaagaaattacttgcagctggacagctagctgatgctttatctcagtttcatgctgccgtagatggtgaccctgataactatattgcttattatcggagggctactgtctttttagctatgggcaaatcaaaagctgcacttcctgatttaactaaagtgattcaattgaagatggacttcactgcagcaagattacagagaggtcacttattactcaaacaaggaaaacttgatgaagcagaagatgattttaaaaaagtgctcaaatctaatccaagtgaaaatgaagaaaaggaagcacagtctcaacttataaaatctgatgaaatgcagcgtttgcgttcacaagcacttaacgcttttggaagtggagattatactgctgctatagccttccttgataagattttagaggtttgtgtttgggatgcagaactacgggaacttcgagctgaatgttttataaaagaaggagaacctaggaaagctataagtgacttaaaagctgcgtcaaagttgaagaatgataatactgaagcgttttataaaataagcacactgtactaccaactaggagaccacgaactgtccctcagtgaagttcgggaatgtcttaaacttgaccaggatcataaaaggtgttttgcacactataaacaagtaaagaaacttaataagctgattgagtcagctgaagagctcatcagagatggcagatacacagatgctaccagcaaatatgaatctgtcatgaaaacagagccaagcattgctgaatatacagttcgttcaaaggagaggatttgccactgcttttctaaggacgagaagcctgttgaagctattagggtttgttctgaagttttacagatggaacctgacaatgtgaatgccctgaaagatcgagcagaggcctatttgatagaggaaatgtatgatgaagctattcaggattatgaaactgctcaggaacacaatgaaaatgatcagcagattcgagaaggtctagagaaagcacaaagattattgaaacagtcgcagaaacgagattattataaaatcttgggagtaaaaagaaatgccaaaaagcaagaaattattaaagcataccgaaaattagcactgcagtggcacccagataacttccagaatgaagaagaaaagaaaaaagctgagaaaaagttcattgatatagcagctgctaaagaagtcctctctgatccagaaatgagaaagaagtttgacgacggagaagatcctttggatgcagagagccagcaaggaggcggcggcaaccctttccacagaagctggaactcatggcaagggttcaatcccttcagctcaggcggaccatttagatttaaattccacttcaattaaaccaactgtttttctgctcttcttaatttttttaaagattaaaaacaaagaaatcttgttccgggaccctaatgaaaaaaaatttcaaatcttttcagtttgtccatgaccaaagagttgctttaataggaaaaaatctgttcttatccctgtcagatttatggttaatgggtttgcaacggcaaggaggcaaggaatggttctatttctgacagagcagcctgcatctgctttatgctgtctggagggaagtggtctgaggcaggctcacccgtggaagtgctcacgtattctgtattatttttctacactggagctgagattcttctcttcacagccttgcagagtaagtcagtgcctacaagtgtaagaaggagctgtaatcttcatgaggatggttatacttcagtattcttaaagagaacatgaacatttttgagctgtatgttcttagggacaactgtgcttcgatgtggtcagtctcgtcacttgtgagtagcaccacagcagcaccacgaatcgcgggggtccacagagcgggc

SEQ ID NO: 285544 - DNA, 1255 bp, Homo sapiens
gcggccgccaccgactccccgtctgcttccctccgggcggcagccgcggtttggagcttgctgacagctctgcgaccggcgggcgcagcctcgtctcgtgcttccacgttatcctatcagggacggggcggggcggcggcctccgcagcctatcagcgcgaaccacgaccccggcgagcccgggaggaaagccgccagaaagaaggcgattggatggcggcggcgctctggggcgtagcgtcgcccgggccccgcccaccgctgccttcctctgctgggctccagagccactgaggcctgagcgagagccgacggcgggcgggcgcagctgctgccggagcgccggcgcgtgctggtgggccacacacctttcctcctcttcactcgcgagccctcggacatggtggcccccggctccgtgaccagccggctgggctcggtattccccttcctgctagtcctggtggatctgcagtacgaaggtgctgaatgtggagtaaatgcagatgttgagaaacatcttgaattgggcaagaaattacttgcagctggacagctagctgatgctttatctcagtttcatgctgccgtagatggtgaccctgataactatattgcttattatcggagggctactgtctttttagctatgggcaaatcaaaagctgcacttcctgatttaactaaagtgattcaattgaagatggacttcactgcagcaagattacagagaggtcacttattactcaaacaaggaaaacttgatgaagcagaagatgattttaaaaaagtgctcaaatctaatccaagtgaaaatgaagaaaaggaagcacagtctcaacttataaaatctgatgaaatgcagcgtttgcgttcacaagcacttaacgcttttggaagtggagattatactgctgctatagccttccttgataagattttagaggtaagtttcttagatactgcagttgaccagcctgacacttattgtaaggcacatttatatacttcgacatgtcacataccacaaagacctagacaggagaaaatcaggttggtccttgggcttttgcctcttaagtataaaatagtgttcctagacaacaaaatttggactgaagttttcagtaaatgtactgaatgtgctgtggcatgagagttaaatatgtttataaattgcttgctttgctattttagttgattttgtatttttttgggaagaaaactctagcggttagataatgggataaaagat

SEQ ID NO: 285545 - DNA, 187 bp, Homo sapiens
aagctgcacttcctgatttaactaaagtgattcaattgaagatggacttcactgcagtaagtatatctcaactttctttaaaggggaacttaacagaacttggggagagataatttgtttcataaggtgaggactggcatgctagacatagctggaagagatcaaagctacagtgatgttgtggact

SEQ ID NO: 285546 - DNA, 321 bp, Homo sapiens
cacccaccctcctctgcccaaagaaaacattccccctgcccctataccttagatattatctggttcttaattttctgatttctttctagaaatgagaaagaagtttgacgacggagaagatcctttggatgcagagagccagcaaggaggcggcggcaaccctttccacagaagctggaactcatggcaagggttcaatcccttcagctcaggcggaccatttagatttaaattccacttcaattaaaccaactgtttttctgctcttcttaatttttttaaagattaaaaacaaagaaatcttgttccgggaccctaatg

SEQ ID NO: 285547 - DNA, 5390 bp, Homo sapiens
  misc_feature (3132)..(3133): n is a, c, g, or t
  misc_feature (5361)..(5361): n is a, c, g, or t
  misc_feature (5384)..(5384): n is a, c, g, or t
aaattattcacaaaaagcagctggaaatcagaaaggcagctgccgctccagggtctcaaatccattaaaaccaccacagaacaattaaaacaatcagagagagaaaaggaaaaggaaacaacgtccaacatttggcatttggttttatccacaggttttcccagagctcctcttggaattgaaagcaaaatatattggcaaacactgcttctcaatacacaggaaggggagcctcagtgcctcctgccaacagaggcggctctgtgcagtcagactgtggggtgcacagcagtctctcaggctggggtttctggcctctttccatccaatcaccccttccaggaaattcagcagcctaccagacactgggcctctgcctggctgccctttcccccaggcagagcggccttgggcataataccaggcaacctgccagccccagagcagaaaccctgctgggatcccttccttcatcaaccttggtgtggaggatgctcaatagcgcttccacctccccctccccagcccctagctacatctctccacccttccctggacagtcctacttcccagctcacccacccaccagcagcttaagtctgggtgggatctatcatcagctcctccccctgtaacctcttccctccacagatccaccctgtgactcctcttcactcgcgagccctcggacatggtggcccccggctccgtgaccagccggctgggctcggtattccccttcctgctagtcctggtggatctgcagtacgaaggtgctgaatgtggagtaaatgcagatgttgagaaacatcttgaattgggcaagaaattacttgcagctggacagctagctgatgctttatctcagtttcatgctgccgtagatggtgaccctgataactatattgcttattatcggagggctactgtctttttagctatgggcaaatcaaaagctgcacttcctgatttaactaaagtgattcaattgaagatggacttcactgcagcaagattacagagaggtcacttattactcaaacaaggaaaacttgatgaagcagaagatgattttaaaaaagtgctcaaatctaatccaagtgaaaatgaagaaaaggaagcacagtctcaacttataaaatctgatgaaatgcagcgtttgcgttcacaagcacttaacgcttttggaagtggagattatactgctgctatagccttccttgataagattttagaggtttgtgtttgggatgcagaactacgggaacttcgagctgaatgttttataaaagaaggagaacctaggaaagctataagtgacttaaaagctgcgtcaaagttgaagaatgataatactgaagcgttttataaaataagcacactgtactaccaactaggagaccacgaactgtccctcagtgaagttcgggaatgtcttaaacttgaccaggatcataaaaggtgttttgcacactataaacaagtaaagaaacttaataagctgattgagtcagctgaagagctcatcagagatggcagatacacagatgctaccagcaaatatgaatctgtcatgaaaacagagccaagcattgctgaatatacagttcgttcaaaggagaggatttgccactgcttttctaaggacgagaagcctgttgaagctattagggtttgttctgaagttttacagatggaacctgacaatgtgaatgccctgaaagatcgagcagaggcctatttgatagaggaaatgtatgatgaagctattcaggattatgaaactgctcaggaacacaatgaaaatgatcagcagattcgagaaggtctagagaaagcacaaagattattgaaacagtcgcagaaacgagattattataaaatcttgggagtaaaaagaaatgccaaaaagcaagaaattattaaagcataccgaaaattagcactgcagtggcacccagataacttccagaatgaagaagaaaagaaaaaagctgagaaaaagttcattgatatagcagctgctaaagaagtcctctctgatccagaaatgagaaagaagtttgacgacggagaagatcctttggatgcagagagccagcaaggaggcggcggcaaccctttccacagaagctggaactcatggcaagggttcaatcccttcagctcaggcggaccatttagatttaaattccacttcaattaaaccaactgtttttctgctcttcttaatttttttaaagattaaaaacaaagaaatcttgttccgggaccctaatgaaaaaaaatttcaaatcttttcagtttgtccatgaccaaagagttgctttaataggaaaaaatctgttcttatccctgtcagatttatggttaatgggtttgcaacggcaaggaggcaaggaatggttctatttctgacagagcagcctgcatctgctttatgctgtctggagggaagtggtctgaggcaggctcacccgtggaagtgctcacgtattctgtattatttttctacactggagctgagattcttctcttcacagccttgcagagtaagtcagtgcctacaagtgtaagaaggagctgtaatcttcatgaggatggttatacttcagtattcttaaagagaacatgaacatttttgagctgtatgttcttagggacaactgtgcttcgatgtggtcagtctcgtcacttgtgagtagctgtgaaatctttagtgtgcatgtgtttgcacctctgtggtctgtcaacgtggctgtcactgaaggagcaagagaccatcttttaggaaccctgccaccaaataataatatatccaggcttagactttggattaatgttaaatgtacatttttttggttcagtacctgaagaagaatactgaaacttgaatctataaattcctatggacccttttaatattaaacacaacaaattaaaagttgttataggtaaaataagttcagataaaatagtggtggtatttaaaataatattgctgaagtgcagattgaaatactttttaaacaactgaagttctgagtttttatagggaatttcatgtaacaagactggtttagaaacgtaaagttgcgcagtcaacataaataaatacagaatgccatgttnnccacttctaagtaaagacagtgggcagcttctgtttctccttctatcaaggcttcaccctatcttaaaggtctgtggtgcctcccacgtgggacctgtctgctggtatgtgttaaacagcagaccggcccttctaccagatcttgatgcctctgattttctcctgcctacaagaaaatacaggcaaggttagtcaggtctggctatatttccactgttgtttcatttaataagatggcatctcctcttgagatatgttcttcttaccttttaagaagatactatttaagaagtgaactattcagtctttgtatactgaatgctttttccctaaaaaatgttaatcaagaatattgaatatttatggcactcttgatgctgcatttgaaagctgaaggaattactttagatagataggaattgctacctttattctggaaaggttttgtttctgcctcaaagcattttgaagtgttttaaccattaaagggtctaatttttttttcttaatgaaatcaagcattttaattcactgtgggaggcatcctgaccacggacatccataacagcaaagcacaaatcgttttcgtctgtagtcatatcctgaaacataggtggacaaatttttaactgagagacaaaaatcacatagttgaattgagcagaacacttaagtgctttctgcatctatttaggagtctatttcttaccaataaacttgacaacgcatttggaaaactagtgaacaccttacagctttcattttgctttaatgtttcaattcaagccggtgtaaaaataatttccaaggcatttctgtttattctttagtaatctcactactggctatgtcagcaatatctttttcaatctggttccttttgtatatgatgtcactgtgacctctttgaaatatagtgatggcttttacctactttgaaaagaattttcacatagagtcagaaaaaaaaggaaatatcaaatcacttgcctttccacttggagagcacgacagttgccaacaacaaggggtcaagggccgcacaggagatgtgtgggggcctggccacctcccacctgctgcccagaggcttgtttgcattttcattttttctccacttgtaacaaccatagtttcagctcctaaattcttatcatggatttacttagtcatcttaactgacctgcagttacttgcctgttttcagtgaagagagagaagcagctctggtgccacatgccagtgccatggagggaaatgaattctctgcaatctgttgtttcgctgattcatgaagaaagtaacaactgttgagtttcagccttgatggctgtcggcagttttctggtgtccacccaaacggagagacagtcactcctgcttaccctaatgtgtgactgagaagcagcctgggtgtgtaaagagatagtcattccccctgcctgtctcactgtagggtagcattatccactgtaaaaccatactactttcattttcccttggggactacaggtgccaggtaaccttttttttttttttttttttttttgagacagaatcttgctctgttgcccaggctggagtgcagggacacctcccgggttcaagcagttctcctgcctcagcctccaagtagctgggactataggcacgcaccaccatgcctggctaatttttgtatttttagtagaaatggggtttcactgtgttagccaggatggtcttgatctcctgaccttgtgatctgcccgccttggccttccaaagtgttgggattacaggcgtgagccactgcgcctggccatcaggtaacctttatggctctttcaggaaaagtgaaatcagagaggcgtaccctagccacagctgttgtattctgctcttctttcctttttggtgagcttcatgggtggagttatcagtggtctgtactttgtggatattttgcccagcaggaagtattagacacatcagtctagaagcattgtgaaaaggttgtttccggtgtggctgtgtctgattcgagtgttgctgccaatgcgcaggtgctctcgaaaggaagtggtgtcagcatttcggcgacggggggtagctctcagagtaagtgatgaggtgcaaacgagttccggtgggcatggattcgctaggcagctcgctcaatgtacgccaggtgacgatggctgcaggtattttggcaccgatggagtgaagtaaaacgccattggatnacaagtatgccggtcaagaaccncttgcc

SEQ ID NO: 285548 - DNA, 3141 bp, Homo sapiens
  misc_feature (3132)..(3133): n is a, c, g, or t
aaattattcacaaaaagcagctggaaatcagaaaggcagctgccgctccagggtctcaaatccattaaaaccaccacagaacaattaaaacaatcagagagagaaaaggaaaaggaaacaacgtccaacatttggcatttggttttatccacaggttttcccagagctcctcttggaattgaaagcaaaatatattggcaaacactgcttctcaatacacaggaaggggagcctcagtgcctcctgccaacagaggcggctctgtgcagtcagactgtggggtgcacagcagtctctcaggctggggtttctggcctctttccatccaatcaccccttccaggaaattcagcagcctaccagacactgggcctctgcctggctgccctttcccccaggcagagcggccttgggcataataccaggcaacctgccagccccagagcagaaaccctgctgggatcccttccttcatcaaccttggtgtggaggatgctcaatagcgcttccacctccccctccccagcccctagctacatctctccacccttccctggacagtcctacttcccagctcacccacccaccagcagcttaagtctgggtgggatctatcatcagctcctccccctgtaacctcttccctccacagatccaccctgtgactcctcttcactcgcgagccctcggacatggtggcccccggctccgtgaccagccggctgggctcggtattccccttcctgctagtcctggtggatctgcagtacgaaggtgctgaatgtggagtaaatgcagatgttgagaaacatcttgaattgggcaagaaattacttgcagctggacagctagctgatgctttatctcagtttcatgctgccgtagatggtgaccctgataactatattgcttattatcggagggctactgtctttttagctatgggcaaatcaaaagctgcacttcctgatttaactaaagtgattcaattgaagatggacttcactgcagcaagattacagagaggtcacttattactcaaacaaggaaaacttgatgaagcagaagatgattttaaaaaagtgctcaaatctaatccaagtgaaaatgaagaaaaggaagcacagtctcaacttataaaatctgatgaaatgcagcgtttgcgttcacaagcacttaacgcttttggaagtggagattatactgctgctatagccttccttgataagattttagaggtttgtgtttgggatgcagaactacgggaacttcgagctgaatgttttataaaagaaggagaacctaggaaagctataagtgacttaaaagctgcgtcaaagttgaagaatgataatactgaagcgttttataaaataagcacactgtactaccaactaggagaccacgaactgtccctcagtgaagttcgggaatgtcttaaacttgaccaggatcataaaaggtgttttgcacactataaacaagtaaagaaacttaataagctgattgagtcagctgaagagctcatcagagatggcagatacacagatgctaccagcaaatatgaatctgtcatgaaaacagagccaagcattgctgaatatacagttcgttcaaaggagaggatttgccactgcttttctaaggacgagaagcctgttgaagctattagggtttgttctgaagttttacagatggaacctgacaatgtgaatgccctgaaagatcgagcagaggcctatttgatagaggaaatgtatgatgaagctattcaggattatgaaactgctcaggaacacaatgaaaatgatcagcagattcgagaaggtctagagaaagcacaaagattattgaaacagtcgcagaaacgagattattataaaatcttgggagtaaaaagaaatgccaaaaagcaagaaattattaaagcataccgaaaattagcactgcagtggcacccagataacttccagaatgaagaagaaaagaaaaaagctgagaaaaagttcattgatatagcagctgctaaagaagtcctctctgatccagaaatgagaaagaagtttgacgacggagaagatcctttggatgcagagagccagcaaggaggcggcggcaaccctttccacagaagctggaactcatggcaagggttcaatcccttcagctcaggcggaccatttagatttaaattccacttcaattaaaccaactgtttttctgctcttcttaatttttttaaagattaaaaacaaagaaatcttgttccgggaccctaatgaaaaaaaatttcaaatcttttcagtttgtccatgaccaaagagttgctttaataggaaaaaatctgttcttatccctgtcagatttatggttaatgggtttgcaacggcaaggaggcaaggaatggttctatttctgacagagcagcctgcatctgctttatgctgtctggagggaagtggtctgaggcaggctcacccgtggaagtgctcacgtattctgtattatttttctacactggagctgagattcttctcttcacagccttgcagagtaagtcagtgcctacaagtgtaagaaggagctgtaatcttcatgaggatggttatacttcagtattcttaaagagaacatgaacatttttgagctgtatgttcttagggacaactgtgcttcgatgtggtcagtctcgtcacttgtgagtagctgtgaaatctttagtgtgcatgtgtttgcacctctgtggtctgtcaacgtggctgtcactgaaggagcaagagaccatcttttaggaaccctgccaccaaataataatatatccaggcttagactttggattaatgttaaatgtacatttttttggttcagtacctgaagaagaatactgaaacttgaatctataaattcctatggacccttttaatattaaacacaacaaattaaaagttgttataggtaaaataagttcagataaaatagtggtggtatttaaaataatattgctgaagtgcagattgaaatactttttaaacaactgaagttctgagtttttatagggaatttcatgtaacaagactggtttagaaacgtaaagttgcgcagtcaacataaataaatacagaatgccatgttnnccacttct

SEQ ID NO: 285549 - DNA, 2613 bp, Homo sapiens
ggccaccgtcgtaggtgcgggccgcatgaatggagcgccgggcgtaaggcaaagcctggcaccgtctgcgcggccgctatctgctcccggagcgtgagtgcggggtgtggggcgtgcgcgtgcgcgctcagagggggctcaaggcgagcgcgccgggcagttgcgggcgcgtggctgctgaggttggcggcggtgccgcgcgcccgacgggccggtggttgcggggcctcccgcctcgacccgggctgggggcagccgtggcggccgccggggaccgcaaggggcggaggaaaggagggggccggtcccggcacgcagaggagcagccgaccatgccccgagacaacatggcctccttgatccaacggatcgcccgccaggcttgcctcaccttccggggcagcgggggcggccgcggcgcttccgatcgcgacgcggcttctggcccggaggcgccgatgcagccgggcttccccgagaacctgagcaagctgaagagcctcctgacccagctccgcgccgaggacttgaacatcgccccgcgcaaggccacactgcagccgctgccgcccaacctgccgccagtcacctacatgcacatctacgagacggacggcttcagcctgggcgtgttcctgctcaagagcggcacgtccatcccgctgcacgaccacccgggcatgcacggcatgctcaaggtgctgtacggcaccgtgcgcatcagctgcatggacaagctagacgcgggcggcgggcaacggccgcgggccttgccgcccgagcagcagttcgagccgccgctgcagccccgggagcgagaagccgtgcggccgggcgtgctgcgttcgcgggccgagtacaccgaggccagcggcccctgcatcctcacaccgcaccgggacaacctgcaccagatcgacgccgtggaagggcctgccgccttcctggacatcctggccccgccctacgacccggacgatggccgggactgccactattaccgggtgctggagccggtcaggcccaaggaggcctccagctcggcctgtgacctgcctcgagaggtgtggctcctggagaccccacaggccgatgacttctggtgcgagggagaaccctatccaggtcccaaggtcttcccttgaagccactggcgcccaggagcggtgggccgaagacgtgccctaccctaccacaagggctgtgtctctaccccctagcctgggcgttggatctactggaatgagcagcagccgcttcctcggcagccttgggaagcacgggcgactggacagcagccgccgggcacggttatgggggcggggtgggcggggaggctagattgtttcctggtactgtcactgccactggggctttgatttggaggaatggggcaggggactatctgaagcgcttccatcctaaagccataatgaaaatatcttcctctcttccccattctatacaaaatactaagtggttttcttgctcccactccctaccccttagttaaatagggtttattttccactcatgcccttatgcctttttttcttatagttttttaacttattgactgtgcatgacccagtggtttgaattgtttttagttcaagtcattggtaaaaactaggtttaaggagatgagctactgtttaaagtgagctggcctgcctaattaattccttgtgaaaactaaatgattttttcagtttggggatcattctcacaacataactatgcatgtagaggacaagatttattttctttcctccctttgcccagtagccacatctggtttactcaggcagcatctactaagaaattcagcacctgcatatctctgtgacatggtcacttagagcttatcttccctatgaatctccagatctgtgagtcgagcagatttcatgttgcagattcacctttaatgcaaagactgtattatcctcacatgactttttttcttgtcttactgtaccttaaaaggtgatagagtaattctgtattttctaacgggaagattcaaaggagctgaatgtgttatgcttccaaacaactgaatgtaaaacactcctagccagttgttgcattccctatatttatttacttccaatattttactgtaaaagtagggagaaatattatgttgatagttgtttcatattctctcaggaactttaatgttcccgactcgggtgattccagctgtgttgctggcagtgttgtctcaaccctctccctaaaatgactgagccctgggttcatctaatgtggttttccttaggaagagatagaaggcacagaagatcacagctagagaattgagaattaactatactactagccattttagggcaccaaaacttgggattaaacacttcctacttcccactcccaactcctgaaatgaagtcttgctatctgtgactagttttatttttgtgcttttaatagtccgagcagtcttaccttgtttacacatgtattgacaccatttgcttcaggccatggagcactgtttctccctttttactatttataggattccgttttttcacaagacttttaataaaaagaaattgtagaaataaacacattaaaatttgccca

SEQ ID NO: 285550 - DNA, 3637 bp, Homo sapiens
gacgtcaactagaacctcaatatggggcgcccttggcagttaactgcggtggctatttctcttcattgtactcgcgacattaacgatgggtgtctatggctcgcgccagcgtgtgcggctccgctcaccggctggggcagcgtcggcgcggacgagggcggaggaaaggagggggccggtcccggcacgcagaggagcagccgaccatgccccgagacaacatggcctccttgatccaacggatcgcccgccaggcttgcctcaccttccggggcagcgggggcggccgcggcgcttccgatcgcgacgcggcttctggcccggaggcgccgatgcagccgggcttccccgagaacctgagcaagctgaagagcctcctgacccagctccgcgccgaggacttgaacatcgccccgcgcaaggccacactgcagccgctgccgcccaacctgccgccagtcacctacatgcacatctacgagacggacggcttcagcctgggcgtgttcctgctcaagagcggcacgtccatcccgctgcacgaccacccgggcatgcacggcatgctcaaggtgctgtacggcaccgtgcgcatcagctgcatggacaagctagacgcgggcggcgggcaacggccgcgggccttgccgcccgagcagcagttcgagccgccgctgcagccccgggagcgagaagccgtgcggccgggcgtgctgcgttcgcgggccgagtacaccgaggccagcggcccctgcatcctcacaccgcaccgggacaacctgcaccagatcgacgccgtggaagggcctgccgccttcctggacatcctggccccgccctacgacccggacgatggccgggactgccactattaccgggtgctggagccggtcaggcccaaggaggcctccagctcggcctgtgacctgcctcgagaggtgtggctcctggagaccccacaggccgatgacttctggtgcgagggagaaccctatccaggtcccaaggtcttcccttgaagccactggcgcccaggagcggtgggccgaagacgtgccctaccctaccacaagggctgtgtctctaccccctagcctgggcgttggatctactggaatgagcagcagccgcttcctcggcagccttgggaagcacgggcgactggacagcagccgccgggcacggttatgggggcggggtgggcggggaggctagattgtttcctggtactgtcactgccactggggctttgatttggaggaatggggcaggggactatctgaagcgcttccatcctaaagccataatgaaaatatcttcctctcttccccattctatacaaaatactaagtggttttcttgctcccactccctaccccttagttaaatagggtttattttccactcatgcccttatgcctttttttcttatagttttttaacttattgactgtgcatgacccagtggtttgaattgtttttagttcaagtcattggtaaaaactaggtttaaggagatgagctactgtttaaagtgagctggcctgcctaattaattccttgtgaaaactaaatgattttttcagtttggggatcattctcacaacataactatgcatgtagaggacaagatttattttctttcctccctttgcccagtagccacatctggtttactcaggcagcatctactaagaaattcagcacctgcatatctctgtgacatggtcacttagagcttatcttccctatgaatctccagatctgtgagtcgagcagatttcatgttgcagattcacctttaatgcaaagactgtattatcctcacatgactttttttcttgtcttactgtaccttaaaaggtgatagagtaattctgtattttctaacgggaagattcaaaggagctgaatgtgttatgcttccaaacaactgaatgtaaaacactcctagccagttgttgcattccctatatttatttacttccaatattttactgtaaaagtagggagaaatattatgttgatagttgtttcatattctctcaggaactttaatgttcccgactcgggtgattccagctgtgttgctggcagtgttgtctcaaccctctccctaaaatgactgagccctgggttcatctaatgtggttttccttaggaagagatagaaggcacagaagatcacagctagagaattgagaattaactatactactagccattttagggcaccaaaacttgggattaaacacttcctacttcccactcccaactcctgaaatgaagtcttgctatctgtgactagttttatttttgtgcttttaatagtccgagcagtcttaccttgtttacacatgtattgacaccatttgcttcaggccatggagcactgtttctccctttttactatttataggattccgttttttcacaagacttttaataaaaagaaattgtagaaataaacacattaaaatttgcccagctgtcgtctaagccctcttgattgacttgcccaagtggcaatagagttctaatatctataataaagggagatttgctattattagtggaatgttgaccccgtatgtagagaaacagtacgtgcctttgcctctttatgcacacagagacccagggtgagggagtatttgttcccagtttttaagatagtataaaaaagcaaatacttggtgagtgatttaaaaataaaaccaaaacaaaacacaaaaagatattccacaggacatgccactttattataaaacctgacacaggcatagtaccaagtatttcctgcattgttgctaaaattgttttattgtagctccacattctggtgtagtttaaaatgcctttgggggcagtttgaagcagttcttcatgccacttagtttgaaaataaaattctagatatgcaaatgattttcttagaaaacttcacaaaataaaagatcttgtttttttttccatagcacagtaatgaatgtggttatcaatcacatacttttttggattatattgtagcaaaaagttgattagcttaccaagattattaatagcaatgtatgtgttataatacaacttagtacattaaagctacgaaaactcatcctggctgtaggatagtaataaaggaagaattatgacttcattatgaaaaaaagaagttttaaagttttcaattacgagcaatttggaagaaaaaacctaaggtgcttttcaaaagagtaactgaaattgttgcaggccaaaacagcaatatgatatctcagatttagttcaataagaacagtgaaacttttggttcactaataaattctgagtaaattagtggtgaagacaaaatataacttgttttagtgagccactgaggaaagaatatgcttattacaaagacaaaatgtggtgcagaaactatcttgcacctgtgtgcataaactgttagtcgtgactgacttggtgtgttgctattgtgtttctatatactccgtccaatatagataatgttttaataacaactgtgggataaaagttatcttccccttggaaagactaatgagcacaatgatattaatcacttttatggtgaataataaatgcaataattgcctcatgggtgagaaaaaaaaaa

SEQ ID NO: 285551 - DNA, 3524 bp, Homo sapiens
ggccaccgtcgtaggtgcgggccgcatgaatggagcgccgggcgtaaggcaaagcctggcaccgtctgcgcggccgctatctgctcccggagcgtgagtgcggggtgtggggcgtgcgcgtgcgcgctcagagggggctcaaggcgagcgcgccgggcagttgcgggcgcgtggctgctgaggttggcggcggtgccgcgcgcccgacgggccggtggttgcggggcctcccgcctcgacccgggctgggggcagccgtggcggccgccggggaccgcaaggggcggaggaaaggagggggccggtcccggcacgcagaggagcagccgaccatgccccgagacaacatggcctccttgatccaacggatcgcccgccaggcttgcctcaccttccggggcagcgggggcggccgcggcgcttccgatcgcgacgcggcttctggcccggaggcgccgatgcagccgggcttccccgagaacctgagcaagctgaagagcctcctgacccagctccgcgccgaggacttgaacatcgcccgagcagcagttcgagccgccgctgcagccccgggagcgagaagccgtgcggccgggcgtgctgcgttcgcgggccgagtacaccgaggccagcggcccctgcatcctcacaccgcaccgggacaacctgcaccagatcgacgccgtggaagggcctgccgccttcctggacatcctggccccgccctacgacccggacgatggccgggactgccactattaccgggtgctggagccggtcaggcccaaggaggcctccagctcggcctgtgacctgcctcgagaggtgtggctcctggagaccccacaggccgatgacttctggtgcgagggagaaccctatccaggtcccaaggtcttcccttgaagccactggcgcccaggagcggtgggccgaagacgtgccctaccctaccacaagggctgtgtctctaccccctagcctgggcgttggatctactggaatgagcagcagccgcttcctcggcagccttgggaagcacgggcgactggacagcagccgccgggcacggttatgggggcggggtgggcggggaggctagattgtttcctggtactgtcactgccactggggctttgatttggaggaatggggcaggggactatctgaagcgcttccatcctaaagccataatgaaaatatcttcctctcttccccattctatacaaaatactaagtggttttcttgctcccactccctaccccttagttaaatagggtttattttccactcatgcccttatgcctttttttcttatagttttttaacttattgactgtgcatgacccagtggtttgaattgtttttagttcaagtcattggtaaaaactaggtttaaggagatgagctactgtttaaagtgagctggcctgcctaattaattccttgtgaaaactaaatgattttttcagtttggggatcattctcacaacataactatgcatgtagaggacaagatttattttctttcctccctttgcccagtagccacatctggtttactcaggcagcatctactaagaaattcagcacctgcatatctctgtgacatggtcacttagagcttatcttccctatgaatctccagatctgtgagtcgagcagatttcatgttgcagattcacctttaatgcaaagactgtattatcctcacatgactttttttcttgtcttactgtaccttaaaaggtgatagagtaattctgtattttctaacgggaagattcaaaggagctgaatgtgttatgcttccaaacaactgaatgtaaaacactcctagccagttgttgcattccctatatttatttacttccaatattttactgtaaaagtagggagaaatattatgttgatagttgtttcatattctctcaggaactttaatgttcccgactcgggtgattccagctgtgttgctggcagtgttgtctcaaccctctccctaaaatgactgagccctgggttcatctaatgtggttttccttaggaagagatagaaggcacagaagatcacagctagagaattgagaattaactatactactagccattttagggcaccaaaacttgggattaaacacttcctacttcccactcccaactcctgaaatgaagtcttgctatctgtgactagttttatttttgtgcttttaatagtccgagcagtcttaccttgtttacacatgtattgacaccatttgcttcaggccatggagcactgtttctccctttttactatttataggattccgttttttcacaagacttttaataaaaagaaattgtagaaataaacacattaaaatttgcccagctgtcgtctaagccctcttgattgacttgcccaagtggcaatagagttctaatatctataataaagggagatttgctattattagtggaatgttgaccccgtatgtagagaaacagtacgtgcctttgcctctttatgcacacagagacccagggtgagggagtatttgttcccagtttttaagatagtataaaaaagcaaatacttggtgagtgatttaaaaataaaaccaaaacaaaacacaaaaagatattccacaggacatgccactttattataaaacctgacacaggcatagtaccaagtatttcctgcattgttgctaaaattgttttattgtagctccacattctggtgtagtttaaaatgcctttgggggcagtttgaagcagttcttcatgccacttagtttgaaaataaaattctagatatgcaaatgattttcttagaaaacttcacaaaataaaagatcttgtttttttttccatagcacagtaatgaatgtggttatcaatcacatacttttttggattatattgtagcaaaaagttgattagcttaccaagattattaatagcaatgtatgtgttataatacaacttagtacattaaagctacgaaaactcatcctggctgtaggatagtaataaaggaagaattatgacttcattatgaaaaaaagaagttttaaagttttcaattacgagcaatttggaagaaaaaacctaaggtgcttttcaaaagagtaactgaaattgttgcaggccaaaacagcaatatgatatctcagatttagttcaataagaacagtgaaacttttggttcactaataaattctgagtaaattagtggtgaagacaaaatataacttgttttagtgagccactgaggaaagaatatgcttattacaaagacaaaatgtggtgcagaaactatcttgcacctgtgtgcataaactgttagtcgtgactgacttggtgtgttgctattgtgtttctatatactccgtccaatatagataatgttttaataacaactgtgggataaaagttatcttccccttggaaagactaatgagcacaatgatattaatcacttttatggtgaataataaatgcaataattgcctcatgggtgagaaaaaaaaaa

SEQ ID NO: 285552 - DNA, 1757 bp, Homo sapiens
aatgcatgagtgaatgaatgaatgaacaaactgaggattatgttatgcccctagacatgagcaataatgaaggaacgcaacaatttgtgcaaaggaaaaatacgcaagggaggcccagtctcatgctttccgctggagaaccccttgtgcatcaactgtctcctctcctcagagctctgctttatgagtagatcaacagcccacaaggagatggcagtgttgtctcaaccctctccctaaaatgactgagccctgggttcatctaatgtggttttccttaggaagagatagaaggcacagaagatcacagctagagaattgagaattaactatactactagccattttagggcaccaaaacttgggattaaacacttcctacttcccactcccaactcctgaaatgaagtcttgctatctgtgactagttttatttttgtgcttttaatagtccgagcagtcttaccttgtttacacatgtattgacaccatttgcttcaggccatggagcactgtttctccctttttactatttataggattccgttttttcacaagacttttaataaaaagaaattgtagaaataaacacattaaaatttgcccagctgtcgtctaagccctcttgattgacttgcccaagtggcaatagagttctaatatctataataaagggagatttgctattattagtggaatgttgaccccgtatgtagagaaacagtacgtgcctttgcctctttatgcacacagagacccagggtgagggagtatttgttcccagtttttaagatagtataaaaaagcaaatacttggtgagtgatttaaaaataaaaccaaaacaaaacacaaaaagatattccacaggacatgccactttattataaaacctgacacaggcatagtaccaagtatttcctgcattgttgctaaaattgttttattgtagctccacattctggtgtagtttaaaatgcctttgggggcagtttgaagcagttcttcatgccacttagtttgaaaataaaattctagatatgcaaatgattttcttagaaaacttcacaaaataaaagatcttgtttttttttccatagcacagtaatgaatgtggttatcaatcacatacttttttggattatattgtagcaaaaagttgattagcttaccaagattattaatagcaatgtatgtgttataatacaacttagtacattaaagctacgaaaactcatcctggctgtaggatagtaataaaggaagaattatgacttcattatgaaaaaaagaagttttaaagttttcaattacgagcaatttggaagaaaaaacctaaggtgcttttcaaaagagtaactgaaattgttgcaggccaaaacagcaatatgatatctcagatttagttcaataagaacagtgaaacttttggttcactaataaattctgagtaaattagtggtgaagacaaaatataacttgttttagtgagccactgaggaaagaatatgcttattacaaagacaaaatgtggtgcagaaactatcttgcacctgtgtgcataaactgttagtcgtgactgacttggtgtgttgctattgtgtttctatatactccgtccaatatagataatgttttaataacaactgtgggataaaagttatcttccccttggaaagactaatgagcacaatgatattaatcacttttatggtgaataataaatgcaataattgcctcatgggtgagaaaaaaaaaa

SEQ ID NO: 285553 - DNA, 2798 bp, Homo sapiens
  misc_feature (2627)..(2628): n is a, c, g, or t
  misc_feature (2653)..(2653): n is a, c, g, or t
  misc_feature (2658)..(2658): n is a, c, g, or t
  misc_feature (2664)..(2665): n is a, c, g, or t
  misc_feature (2681)..(2681): n is a, c, g, or t
  misc_feature (2708)..(2708): n is a, c, g, or t
ggccaccgtcgtaggtgcgggccgcatgaatggagcgccgggcgtaaggcaaagcctggcaccgtctgcgcggccgctatctgctcccggagcgtgagtgcggggtgtggggcgtgcgcgtgcgcgctcagagggggctcaaggcgagcgcgccgggcagttgcgggcgcgtggctgctgaggttggcggcggtgccgcgcgcccgacgggccggtggttgcggggcctcccgcctcgacccgggctgggggcagccgtggcggccgccggggaccgcaaggggcggaggaaaggagggggccggtcccggcacgcagaggagcagccgaccatgccccgagacaacatggcctccttgatccaacggatcgcccgccaggcttgcctcaccttccggggcagcgggggcggccgcggcgcttccgatcgcgacgcggcttctggcccggaggcgccgatgcagccgggcttccccgagaacctgagcaagctgaagagcctcctgacccagctccgcgccgaggacttgaacatcgccccgcgcaaggccacactgcagccgctgccgcccaacctgccgccagtcacctacatgcacatctacgagacggacggcttcagcctgggcgtgttcctgctcaagagcggcacgtccatcccgctgcacgaccacccgggcatgcacggcatgctcaaggtgctgtacggcaccgtgcgcatcagctgcatggacaagctagacgcgggcggcgggcaacggccgcgggccttgccgcccgagcagcagttcgagccgccgctgcagccccgggagcgagaagccgtgcggccgggcgtgctgcgttcgcgggccgagtacaccgaggccagcggcccctgcatcctcacaccgcaccgggacaacctgcaccagatcgacgccgtggaagggcctgccgccttcctggacatcctggccccgccctacgacccggacgatggccgggactgccactattaccgggtgctggagccggtcaggcccaaggaggcctccagctcggcctgtgacctgcctcgagaggtgtggctcctggagaccccacaggccgatgacttctggtgcgagggagaaccctatccaggtcccaaggtcttcccttgaagccactggcgcccaggagcggtgggccgaagacgtgccctaccctaccacaagggctgtgtctctaccccctagcctgggcgttggatctactggaatgagcagcagccgcttcctcggcagccttgggaagcacgggcgactggacagcagccgccgggcacggttatgggggcggggtgggcggggaggctagattgtttcctggtactgtcactgccactggggctttgatttggaggaatggggcaggggactatctgaagcgcttccatcctaaagccataatgaaaatatcttcctctcttccccattctatacaaaatactaagtggttttcttgctcccactccctaccccttagttaaatagggtttattttccactcatgcccttatgcctttttttcttatagttttttaacttattgactgtgcatgacccagtggtttgaattgtttttagttcaagtcattggtaaaaactaggtttaaggagatgagctactgtttaaagtgagctggcctgcctaattaattccttgtgaaaactaaatgattttttcagtttggggatcattctcacaacataactatgcatgtagaggacaagatttattttctttcctccctttgcccagtagccacatctggtttactcaggcagcatctactaagaaattcagcacctgcatatctctgtgacatggtcacttagagcttatcttccctatgaatctccagatctgtgagtcgagcagatttcatgttgcagattcacctttaatgcaaagactgtattatcctcacatgactttttttcttgtcttactgtaccttaaaaggtgatagagtaattctgtattttctaacgggaagattcaaaggagctgaatgtgttatgcttccaaacaactgaatgtaaaacactcctagccagttgttgcattccctatatttatttacttccaatattttactgtaaaagtagggagaaatattatgttgatagttgtttcatattctctcaggaactttaatgttcccgactcgggtgattccagctgtgttgctggcagtgttgtctcaaccctctccctaaaatgactgagccctgggttcatctaatgtggttttccttaggaagagatagaaggcacagaagatcacagctagagaattgagaattaactatactactagccattttagggcaccaaaacttgggattaaacacttcctacttcccactcccaactcctgaaatgaagtcttgctatctgtgactagttttatttttgtgcttttaatagtccgagcagtcttaccttgtttacacatgtattgacaccatttgcttcaggccatggagcactgtttctccctttttactatttataggattccgttttttcacaagacttttaataaaaagaaattgtagaaataaacacattaaaatttgcccaaaaaaaaaaaaaannaaaaaaaaaaaaaaaaaataaatanattanaaaatnntaattttaaattttanaattttttatatatattttttaatttntattaatttataatatttattttatatttatattttattaatttaaatataatttatttaccccttttcctccttctcctattctcacca

SEQ ID NO: 285554 - DNA, 3763 bp, Homo sapiens
ggccaccgtcgtaggtgcgggccgcatgaatggagcgccgggcgtaaggcaaagcctggcaccgtctgcgcggccgctatctgctcccggagcgtgagtgcggggtgtggggcgtgcgcgtgcgcgctcagagggggctcaaggcgagcgcgccgggcagttgcgggcgcgtggctgctgaggttggcggcggtgccgcgcgcccgacgggccggtggttgcggggcctcccgcctcgacccgggctgggggcagccgtggcggccgccggggaccgcaaggggcggaggaaaggagggggccggtcccggcacgcagaggagcagccgaccatgccccgagacaacatggcctccttgatccaacggatcgcccgccaggcttgcctcaccttccggggcagcgggggcggccgcggcgcttccgatcgcgacgcggcttctggcccggaggcgccgatgcagccgggcttccccgagaacctgagcaagctgaagagcctcctgacccagctccgcgccgaggacttgaacatcgccccgcgcaaggccacactgcagccgctgccgcccaacctgccgccagtcacctacatgcacatctacgagacggacggcttcagcctgggcgtgttcctgctcaagagcggcacgtccatcccgctgcacgaccacccgggcatgcacggcatgctcaaggtgctgtacggcaccgtgcgcatcagctgcatggacaagctagacgcgggcggcgggcaacggccgcgggccttgccgcccgagcagcagttcgagccgccgctgcagccccgggagcgagaagccgtgcggccgggcgtgctgcgttcgcgggccgagtacaccgaggccagcggcccctgcatcctcacaccgcaccgggacaacctgcaccagatcgacgccgtggaagggcctgccgccttcctggacatcctggccccgccctacgacccggacgatggccgggactgccactattaccgggtgctggagccggtcaggcccaaggaggcctccagctcggcctgtgacctgcctcgagaggtgtggctcctggagaccccacaggccgatgacttctggtgcgagggagaaccctatccaggtcccaaggtcttcccttgaagccactggcgcccaggagcggtgggccgaagacgtgccctaccctaccacaagggctgtgtctctaccccctagcctgggcgttggatctactggaatgagcagcagccgcttcctcggcagccttgggaagcacgggcgactggacagcagccgccgggcacggttatgggggcggggtgggcggggaggctagattgtttcctggtactgtcactgccactggggctttgatttggaggaatggggcaggggactatctgaagcgcttccatcctaaagccataatgaaaatatcttcctctcttccccattctatacaaaatactaagtggttttcttgctcccactccctaccccttagttaaatagggtttattttccactcatgcccttatgcctttttttcttatagttttttaacttattgactgtgcatgacccagtggtttgaattgtttttagttcaagtcattggtaaaaactaggtttaaggagatgagctactgtttaaagtgagctggcctgcctaattaattccttgtgaaaactaaatgattttttcagtttggggatcattctcacaacataactatgcatgtagaggacaagatttattttctttcctccctttgcccagtagccacatctggtttactcaggcagcatctactaagaaattcagcacctgcatatctctgtgacatggtcacttagagcttatcttccctatgaatctccagatctgtgagtcgagcagatttcatgttgcagattcacctttaatgcaaagactgtattatcctcacatgactttttttcttgtcttactgtaccttaaaaggtgatagagtaattctgtattttctaacgggaagattcaaaggagctgaatgtgttatgcttccaaacaactgaatgtaaaacactcctagccagttgttgcattccctatatttatttacttccaatattttactgtaaaagtagggagaaatattatgttgatagttgtttcatattctctcaggaactttaatgttcccgactcgggtgattccagctgtgttgctggcagtgttgtctcaaccctctccctaaaatgactgagccctgggttcatctaatgtggttttccttaggaagagatagaaggcacagaagatcacagctagagaattgagaattaactatactactagccattttagggcaccaaaacttgggattaaacacttcctacttcccactcccaactcctgaaatgaagtcttgctatctgtgactagttttatttttgtgcttttaatagtccgagcagtcttaccttgtttacacatgtattgacaccatttgcttcaggccatggagcactgtttctccctttttactatttataggattccgttttttcacaagacttttaataaaaagaaattgtagaaataaacacattaaaatttgcccagctgtcgtctaagccctcttgattgacttgcccaagtggcaatagagttctaatatctataataaagggagatttgctattattagtggaatgttgaccccgtatgtagagaaacagtacgtgcctttgcctctttatgcacacagagacccagggtgagggagtatttgttcccagtttttaagatagtataaaaaagcaaatacttggtgagtgatttaaaaataaaaccaaaacaaaacacaaaaagatattccacaggacatgccactttattataaaacctgacacaggcatagtaccaagtatttcctgcattgttgctaaaattgttttattgtagctccacattctggtgtagtttaaaatgcctttgggggcagtttgaagcagttcttcatgccacttagtttgaaaataaaattctagatatgcaaatgattttcttagaaaacttcacaaaataaaagatcttgtttttttttccatagcacagtaatgaatgtggttatcaatcacatacttttttggattatattgtagcaaaaagttgattagcttaccaagattattaatagcaatgtatgtgttataatacaacttagtacattaaagctacgaaaactcatcctggctgtaggatagtaataaaggaagaattatgacttcattatgaaaaaaagaagttttaaagttttcaattacgagcaatttggaagaaaaaacctaaggtgcttttcaaaagagtaactgaaattgttgcaggccaaaacagcaatatgatatctcagatttagttcaataagaacagtgaaacttttggttcactaataaattctgagtaaattagtggtgaagacaaaatataacttgttttagtgagccactgaggaaagaatatgcttattacaaagacaaaatgtggtgcagaaactatcttgcacctgtgtgcataaactgttagtcgtgactgacttggtgtgttgctattgtgtttctatatactccgtccaatatagataatgttttaataacaactgtgggataaaagttatcttccccttggaaagactaatgagcacaatgatattaatcacttttatggtgaataataaatgcaataattgcctcatgggtgagaaaaaaaaaa

SEQ ID NO: 285555 - DNA, 3615 bp, Homo sapiens
ggccaccgtcgtaggtgcgggccgcatgaatggagcgccgggcgtaaggcaaagcctggcaccgtctgcgcggccgctatctgctcccggagcgtgagtgcggggtgtggggcgtgcgcgtgcgcgctcagagggggctcaaggcgagcgcgccgggcagttgcgggcgcgtggctgctgaggttggcggcggtgccgcgcgcccgacgggccggtggttgcggggcctcccgcctcgacccgggctgggggcagccgtggcggccgcggcgcttccgatcgcgacgcggcttctggcccggaggcgccgatgcagccgggcttccccgagaacctgagcaagctgaagagcctcctgacccagctccgcgccgaggacttgaacatcgccccgcgcaaggccacactgcagccgctgccgcccaacctgccgccagtcacctacatgcacatctacgagacggacggcttcagcctgggcgtgttcctgctcaagagcggcacgtccatcccgctgcacgaccacccgggcatgcacggcatgctcaaggtgctgtacggcaccgtgcgcatcagctgcatggacaagctagacgcgggcggcgggcaacggccgcgggccttgccgcccgagcagcagttcgagccgccgctgcagccccgggagcgagaagccgtgcggccgggcgtgctgcgttcgcgggccgagtacaccgaggccagcggcccctgcatcctcacaccgcaccgggacaacctgcaccagatcgacgccgtggaagggcctgccgccttcctggacatcctggccccgccctacgacccggacgatggccgggactgccactattaccgggtgctggagccggtcaggcccaaggaggcctccagctcggcctgtgacctgcctcgagaggtgtggctcctggagaccccacaggccgatgacttctggtgcgagggagaaccctatccaggtcccaaggtcttcccttgaagccactggcgcccaggagcggtgggccgaagacgtgccctaccctaccacaagggctgtgtctctaccccctagcctgggcgttggatctactggaatgagcagcagccgcttcctcggcagccttgggaagcacgggcgactggacagcagccgccgggcacggttatgggggcggggtgggcggggaggctagattgtttcctggtactgtcactgccactggggctttgatttggaggaatggggcaggggactatctgaagcgcttccatcctaaagccataatgaaaatatcttcctctcttccccattctatacaaaatactaagtggttttcttgctcccactccctaccccttagttaaatagggtttattttccactcatgcccttatgcctttttttcttatagttttttaacttattgactgtgcatgacccagtggtttgaattgtttttagttcaagtcattggtaaaaactaggtttaaggagatgagctactgtttaaagtgagctggcctgcctaattaattccttgtgaaaactaaatgattttttcagtttggggatcattctcacaacataactatgcatgtagaggacaagatttattttctttcctccctttgcccagtagccacatctggtttactcaggcagcatctactaagaaattcagcacctgcatatctctgtgacatggtcacttagagcttatcttccctatgaatctccagatctgtgagtcgagcagatttcatgttgcagattcacctttaatgcaaagactgtattatcctcacatgactttttttcttgtcttactgtaccttaaaaggtgatagagtaattctgtattttctaacgggaagattcaaaggagctgaatgtgttatgcttccaaacaactgaatgtaaaacactcctagccagttgttgcattccctatatttatttacttccaatattttactgtaaaagtagggagaaatattatgttgatagttgtttcatattctctcaggaactttaatgttcccgactcgggtgattccagctgtgttgctggcagtgttgtctcaaccctctccctaaaatgactgagccctgggttcatctaatgtggttttccttaggaagagatagaaggcacagaagatcacagctagagaattgagaattaactatactactagccattttagggcaccaaaacttgggattaaacacttcctacttcccactcccaactcctgaaatgaagtcttgctatctgtgactagttttatttttgtgcttttaatagtccgagcagtcttaccttgtttacacatgtattgacaccatttgcttcaggccatggagcactgtttctccctttttactatttataggattccgttttttcacaagacttttaataaaaagaaattgtagaaataaacacattaaaatttgcccagctgtcgtctaagccctcttgattgacttgcccaagtggcaatagagttctaatatctataataaagggagatttgctattattagtggaatgttgaccccgtatgtagagaaacagtacgtgcctttgcctctttatgcacacagagacccagggtgagggagtatttgttcccagtttttaagatagtataaaaaagcaaatacttggtgagtgatttaaaaataaaaccaaaacaaaacacaaaaagatattccacaggacatgccactttattataaaacctgacacaggcatagtaccaagtatttcctgcattgttgctaaaattgttttattgtagctccacattctggtgtagtttaaaatgcctttgggggcagtttgaagcagttcttcatgccacttagtttgaaaataaaattctagatatgcaaatgattttcttagaaaacttcacaaaataaaagatcttgtttttttttccatagcacagtaatgaatgtggttatcaatcacatacttttttggattatattgtagcaaaaagttgattagcttaccaagattattaatagcaatgtatgtgttataatacaacttagtacattaaagctacgaaaactcatcctggctgtaggatagtaataaaggaagaattatgacttcattatgaaaaaaagaagttttaaagttttcaattacgagcaatttggaagaaaaaacctaaggtgcttttcaaaagagtaactgaaattgttgcaggccaaaacagcaatatgatatctcagatttagttcaataagaacagtgaaacttttggttcactaataaattctgagtaaattagtggtgaagacaaaatataacttgttttagtgagccactgaggaaagaatatgcttattacaaagacaaaatgtggtgcagaaactatcttgcacctgtgtgcataaactgttagtcgtgactgacttggtgtgttgctattgtgtttctatatactccgtccaatatagataatgttttaataacaactgtgggataaaagttatcttccccttggaaagactaatgagcacaatgatattaatcacttttatggtgaataataaatgcaataattgcctcatgggtgagaaaaaaaaaa

SEQ ID NO: 285556 - DNA, 3471 bp, Homo sapiens
ggccaccgtcgtaggtgcgggccgcatgaatggagcgccgggcgtaaggcaaagcctggcaccgtctgcgcggccgctatctgctcccggagcgtgagtgcggggtgtggggcgtgcgcgtgcgcgctcagagggggctcaaggcgagcgcgccgggcagttgcgggcgcgtggctgctgaggttggcggcggtgccgcgcgcccgacgggccggtggttgcggggcctcccgcctcgacccgggctgggggcagccgtggcggccgccggggaccgcaaggggcggaggaaaggagggggccggtcccggcacgcagaggagcagccgaccatgccccgagacaacatggcctccttgatccaacggatcgcccgccaggcttgcctcaccttccggggcagcgggggcggccgcggcgcttccgatcgcgacgcggcttctggcccggaggcgccgatgcagccgggcttccccgagaacctgagcaagctgaagagcctcctgacccagctccgcgccgaggacttgaacatcgccccgcgcaaggccacactgcagccgagtacaccgaggccagcggcccctgcatcctcacaccgcaccgggacaacctgcaccagatcgacgccgtggaagggcctgccgccttcctggacatcctggccccgccctacgacccggacgatggccgggactgccactattaccgggtgctggagccggtcaggcccaaggaggcctccagctcggcctgtgacctgcctcgagaggtgtggctcctggagaccccacaggccgatgacttctggtgcgagggagaaccctatccaggtcccaaggtcttcccttgaagccactggcgcccaggagcggtgggccgaagacgtgccctaccctaccacaagggctgtgtctctaccccctagcctgggcgttggatctactggaatgagcagcagccgcttcctcggcagccttgggaagcacgggcgactggacagcagccgccgggcacggttatgggggcggggtgggcggggaggctagattgtttcctggtactgtcactgccactggggctttgatttggaggaatggggcaggggactatctgaagcgcttccatcctaaagccataatgaaaatatcttcctctcttccccattctatacaaaatactaagtggttttcttgctcccactccctaccccttagttaaatagggtttattttccactcatgcccttatgcctttttttcttatagttttttaacttattgactgtgcatgacccagtggtttgaattgtttttagttcaagtcattggtaaaaactaggtttaaggagatgagctactgtttaaagtgagctggcctgcctaattaattccttgtgaaaactaaatgattttttcagtttggggatcattctcacaacataactatgcatgtagaggacaagatttattttctttcctccctttgcccagtagccacatctggtttactcaggcagcatctactaagaaattcagcacctgcatatctctgtgacatggtcacttagagcttatcttccctatgaatctccagatctgtgagtcgagcagatttcatgttgcagattcacctttaatgcaaagactgtattatcctcacatgactttttttcttgtcttactgtaccttaaaaggtgatagagtaattctgtattttctaacgggaagattcaaaggagctgaatgtgttatgcttccaaacaactgaatgtaaaacactcctagccagttgttgcattccctatatttatttacttccaatattttactgtaaaagtagggagaaatattatgttgatagttgtttcatattctctcaggaactttaatgttcccgactcgggtgattccagctgtgttgctggcagtgttgtctcaaccctctccctaaaatgactgagccctgggttcatctaatgtggttttccttaggaagagatagaaggcacagaagatcacagctagagaattgagaattaactatactactagccattttagggcaccaaaacttgggattaaacacttcctacttcccactcccaactcctgaaatgaagtcttgctatctgtgactagttttatttttgtgcttttaatagtccgagcagtcttaccttgtttacacatgtattgacaccatttgcttcaggccatggagcactgtttctccctttttactatttataggattccgttttttcacaagacttttaataaaaagaaattgtagaaataaacacattaaaatttgcccagctgtcgtctaagccctcttgattgacttgcccaagtggcaatagagttctaatatctataataaagggagatttgctattattagtggaatgttgaccccgtatgtagagaaacagtacgtgcctttgcctctttatgcacacagagacccagggtgagggagtatttgttcccagtttttaagatagtataaaaaagcaaatacttggtgagtgatttaaaaataaaaccaaaacaaaacacaaaaagatattccacaggacatgccactttattataaaacctgacacaggcatagtaccaagtatttcctgcattgttgctaaaattgttttattgtagctccacattctggtgtagtttaaaatgcctttgggggcagtttgaagcagttcttcatgccacttagtttgaaaataaaattctagatatgcaaatgattttcttagaaaacttcacaaaataaaagatcttgtttttttttccatagcacagtaatgaatgtggttatcaatcacatacttttttggattatattgtagcaaaaagttgattagcttaccaagattattaatagcaatgtatgtgttataatacaacttagtacattaaagctacgaaaactcatcctggctgtaggatagtaataaaggaagaattatgacttcattatgaaaaaaagaagttttaaagttttcaattacgagcaatttggaagaaaaaacctaaggtgcttttcaaaagagtaactgaaattgttgcaggccaaaacagcaatatgatatctcagatttagttcaataagaacagtgaaacttttggttcactaataaattctgagtaaattagtggtgaagacaaaatataacttgttttagtgagccactgaggaaagaatatgcttattacaaagacaaaatgtggtgcagaaactatcttgcacctgtgtgcataaactgttagtcgtgactgacttggtgtgttgctattgtgtttctatatactccgtccaatatagataatgttttaataacaactgtgggataaaagttatcttccccttggaaagactaatgagcacaatgatattaatcacttttatggtgaataataaatgcaataattgcctcatgggtgagaaaaaaaaaa

SEQ ID NO: 285557 - DNA, 2593 bp, Homo sapiens
  misc_feature (1199)..(1199): n is a, c, g, or t
gagaaaactggcggggatagctgtatcaggggctagcacctttaaggagcctctcagtgtggagcaggggagccccagaaaccacaggaagaatttttttggtgtctgtttggtggttcaggctgtacatagggcacggttggggttaagcactccatctaccaggatgggtggtgctagagggcagtgaatcaagaaaggagccaaaaccaacagaacagggatagagaagtgagcgagaggaggttcagtttgctcagtccctctttaaccactacttagagtacatggtctaatgcttagggccaaggagggaggtgaaggctaaggaagtcagatttgagatgcataaccagcagcaaaagagcctctagaaacgccatggactttaggaagggccaagtgacaccttccatgatgtttggttctggtccagatggatctggaagacaaagatttggggagagtgaccacatggctggtagcaataacaaggcctctggctctgaattgcttcctatggtcctggtagaaactgcatagttcagagccaaggggagatgagaagccttaacgtggaagagggacaagagagatgaattgctccctctgcaacccaactcttcaaagtaagaatggttgagagcaatagtcaccaatttcccaggccagaacctggggtcctttgctgggaccagttctgcactttccctctcctcttcctccctcctttcaatcttatactcaagtaaacccactcagcatcttggctatgacgcttcaagatcctggagcactgcatgtaaagagaagagagaagaaatgggttgaagaaactctggaggacctggaagacctagtggctaagctaggaacctggtgaaagagaaagaagatagtccagacggtgatgggcacttgtgaacagaagactctagctcagaaaagcagacagatgtgtgagggggagagatggggtagaacaaaggaactcgagagtcccctacatgacagcctccaggagggctgagtctgaagtagttacagaagagagacaggggcggtaatgttgataggggaatgaagagagagaagcaggagcagaaaaatgaccaaagatgacaatatgctttggccggtaaactcttataaaacataaaggaatcgattaatccctaacttgatggaacaagctttgnaatactttgttcctgtctgccctgatggttaaactaaagaaggagggaggggaggagacagaatcagccagtcagattctgggcccttcccttttcactaccaagcaatctttaataataaggccacaaaatgaggttgccaaggcttagtggggtggtgggaaagaccccaccactacactaaagtcaagggacaaaatgaggtacccaaatagctctgcaaatagatgaaaaagaattagaactcttgagggtttctttctttttggtggcaggtagagagaaggaataaagcttatggaaaaactggaaaatactgctacttcatacatcaaaggtaaccttacattctccgtaagtgaatgttttaactagaattaaggaagaggaaaaaggaaacgggtaaataagcagctatgggagacctgagtcctgagtccatggggtggctggggctgggtcagcgggtaatatgtcatcaaatctagcctccctctatctggcaggaagtggcatgctggtaaggaacaaaaaggtaacagccacggcttagtgggaagagagggaactgagaaaccccaaacctagaagtgccaagggttagtgttaaaagagacagatacacgtgcatggggcaggggtgattgttcggaccatctggaaaggcctttggctgtggatgcatcagaaaccccaccctgggggatgatctatgaggctccggggctgggaggcccccagcacaggtgtcaaacgtacatgaccacatggctaaaaagccccatatctgtccattactcacaacacacaattccccccacccatattgccatgtccaaggcagatgggaggggataagatgacatctctcttggctcttgggcgggcgagctctggctgaggacctctccaccagaggaggcatcatctgcccgcagactgggactgtggggtcatgattacatgcgattgtatcggcatgctcagttctgtcctttggctggccatctgagtgaggaccgaggtggccacagcttcagctgcagagcgaacactgaggccattgctaggggctgttgctgagctgtgctgaatcacaggggctggagaacccgttggctctgagctttccttggggctttctgccaggaaggagggcaaagagcagagagcaattggttagaaaacagaatggggaaagaggcaggactaccttttgccataattctaaaggagcccaaaagggaaatgaaacccatcttttttttggggaaaacttcccagaatcctggcttctaagtcataaatgggctaggaaatgggaagttgtaagaagggaagaactaggccaaaattaacctatctattccaataaaatgaatctccaacatgtt

SEQ ID NO: 285558 - DNA, 1759 bp, Homo sapiens
gagaaaactggcggggatagctgtatcaggggctagcacctttaaggagcctctcagtgtggagcaggggagccccagaaaccacaggaagaatttttttggtgtctgtttggtggttcaggctgtacatagggcacggttggggttaagcactccatctaccaggatgggtggtgctagagggcagtgaatcaagaaaggagccaaaaccaacagaacagggatagagaagtgagcgagaggaggttcagtttgctcagtccctctttaaccactacttagagtacatggtctaatgcttagggccaaggagggaggtgaaggctaaggaagtcagatttgagatgcataaccagcagcaaaagagtaagtaaagggggcatgactttttttttgttggcctctctagtattgtgggaggctttcttagacttttcaactctaagcaaactttctgttaggggaatggggcagaaagtgagcagaccagaagacctggttctgtcccctccctctgtggccttgggtacgtggcagctagctagagtgcttgtgtatcgagcactcacattggagtggggtgggaagcctgagtcctgtattcacatgaacgaattcaggacacccaccatacactcagctcctttctgaaagtgtcctcccttaggcctctagaaacgccatggactttaggaagggccaagtgacaccttccatgatgtttggttctggtccagatggatctggaagacaaagatttggggagagtgaccacatggctggtagcaataacaaggtaagtgaagttacctttgactatcagagaagtttcagggcagcaattattctgcctccttagtgagactgagaaccaactcaagaactatctagggggttctgacctgctgcttccttatttcagtgccattttgttactgtggttctggcagtgctcctcactgaggtcccgtacacatcttcccactgataaaaatgaagttaggactagataattagtcatgggggctaagaaataaaaaagacccgctacataaattagccacccaacacagggacagactggcagggcatgtatgcagttacaaattaattcttaactgtaaaaacacttgactgaagggggaagaaaaatagtcaagagtcttaggaaagctccttaggagccataaactcagtcaagctttagggcaaggctgctactgggaaatcaagacaataaaaaaatgaaacaaaactctaaagcaggagaaaatcccagggagcagccagctaaaggggaagtcctgagcacaagttacggctgtgaatttttaaaaggcaaaagtgaagtccctggatgtggtaacctgcgtcctgaccatctgccataacatttgctagtctgaatcacttcagggcctattcctgttgggtacctgatggtagaggatgagaaaaccgtgttttctctcctttgtctttaggggtgtggcctgttcagcaccagctctgaaaagcaggaggggaaatttaaaacaaatgcagcagaacctgttacctgactggttcactaggacaggatatcactttaaggaaacgggaatcttgtagcttagaacattttctcattcccctgtgacagtcaattttggagacaaaataagaaaggaagctggcagttattttgtatgtatgtttaagatggaggtaggaaagatggagagaaggacattcttggcttgcacagatggcagaaagt

SEQ ID NO: 285559 - DNA, 1562 bp, Homo sapiens
gagaaaactggcggggatagctgtatcaggggctagcacctttaaggagcctctcagtgtggagcaggggagccccagaaaccacaggaagaatttttttggtgtctgtttggtggttcaggctgtacatagggcacggttggggttaagcactccatctaccaggatgggtggtgctagagggcagtgaatcaagaaaggagccaaaaccaacagaacagggatagagaagtgagcgagaggaggttcagtttgctcagtccctctttaaccactacttagagtacatggtctaatgcttagggccaaggagggaggtgaaggctaaggaagtcagatttgagatgcataaccagcagcaaaagagtaagtaaagggggcatgactttttttttgttggcctctctagtattgtgggaggctttcttagacttttcaactctaagcaaactttctgttaggggaatggggcagaaagtgagcagaccagaagacctggttctgtcccctccctctgtggccttgggtacgtggcagctagctagagtgcttgtgtatcgagcactcacattggagtggggtgggaagcctgagtcctgtattcacatgaacgaattcaggacacccaccatacactcagctcctttctgaaagtgtcctcccttaggcctctagaaacgccatggactttaggaagggccaagtgacaccttccatgatgtttggttctggtccagatggatctggaagacaaagatttggggagagtgaccacatggctggtagcaataacaaggtaagtgaagttacctttgactatcagagaagtttcagggcagcaattattctgcctccttagtgagactgagaaccaactcaagaactatctagggggttctgacctgctgcttccttatttcagtgccattttgttactgtggttctggcagtgctcctcactgaggtcccgtacacatcttcccactgataaaaatgaagttaggactagataattagtcatgggggctaagaaataaaaaagacccgctacataaattagccacccaacacagggacagactggcagggcatgtatgcagttacaaattaattcttaactgtaaaaacacttgactgaagggggaagaaaaatagtcaagagtcttaggaaagctccttaggagccataaactcagtcaagctttagggcaaggctgctactgggaaatcaagacaataaaaaaatgaaacaaaactctaaagcaggagaaaatcccagggagcagccagctaaaggggaagtcctgagcacaagttacggctgtgaatttttaaaaggcaaaagtgaagtccctggatgtggtaacctgcgtcctgaccatctgccataacatttgctagtctgaatcatcccaggcacactcctgaagacacggacggtacgaggtgagaacccgcagtcattctaatgatacgacgtggccacagcgacagctcagagagaacaaggaaggatagcaaaacgaggacacactagaaacaggtacatgacaggtacatga

SEQ ID NO: 285560 - DNA, 340 bp, Homo sapiens
cattttatccagtaacatcgtgtttgtttttaatatcaaaaaatgtttcccaaagccaccaaggaaaattcctccagaaggcagggtctgcctcctctgtcacccaggctggagtacagtggcatgatctcggctcactacaacctgggaggcggacgttgcagtgagctgagatcacaccactgcactccagcctgggacagagcaagactccgtctcaaaaaaaaagaaaagaaaagaaataacacaggtacaagtcatcaaaatcctgaattataattgattatactaagtaatgtgttgttatgagagatttttaaataaaaacttttaattgtaa

SEQ ID NO: 285561 - DNA, 6210 bp, Homo sapiens
  misc_feature (3166)..(3166): n is a, c, g, or t
  misc_feature (5646)..(5646): n is a, c, g, or t
  misc_feature (5687)..(5687): n is a, c, g, or t
gcgctccgtcccttctagaggcaggcagagggaagagaaagggtctgttgtttttctctcctgtttctcgctccctctctgctgatcacaaagctgctgaccgggtcagaaagtcctgatggaaatccaccagcgctgggcaggcccctcctcctccagggagcttgtccttgcctaatttttcttcgtcctgatgagaacaaaaaagagagagagaagaaaagaaaaaccacaaacttcctttgaaaaccagcttgtagtcagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaagtaaaaactttattttaatcatcttcttcacctcttctcccacccttctctatttcctctccagctttggggagctgacacctgctgtccttccacctttggtctgcaagtctggattgcttagaggagctaagtcaggagagacatgtaaaggggatgctgcttggtcctcctccttttaatgaaagcacgaaaccttccccctctccttggaagctgactccacccatgtgttcaatcccaccagtcttccctcccaagtctggaagccccacgacctcttggtctcatctggtcacagcaagttagaggtggaaagagctcagcacggggcccttctgtttacacatatactgcccatagccaggagttactgcacaaacactagccagccttctacactacattccttttccaagacttttctgggttagtttgctttccagcccactgatttccttcttattggacaggtcactcttttgcatcccaagcctggcttaggcaagtccctgaggttagtaaacaccttcagtgcccctcagccgagtcccttttgaccatggaataccatcagcctgaggatccagcccctggtaaggccgggactgcagaagcagtcatccctgaaaaccatgaggttctggcaggcccagatgagcaccctcaggacacagatgcaagagatgctgatggggaggctagagaacgggagccagcagaccaagctttgctgcctagccagtgtggggacaaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaaagcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccacccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggcacggtggctcactcctgtaatctcaacaatttgagaggccaaggtgggcggatcacctgaggttaggagttcgagaccagcctgcccaaaaaggtgaaaccccgtctctactaaaaatacaagaaattactgggactacaggcatgcgccactgcgcccagctantttttgtatttttagtagagacggtttcgccactttggtcaggctagtcttgaattcctgacctcaagtaatccgcctgccttggcctcccgaagtgctggaattacaggcgtgagccactgcgcccagctacctgtcatttctaatatagcctgcagggggaaccaaagcctgactttttgtttttgtttctgtttttgtttttgttttctatgggaaatagtgctctcctgggaggtgggtttccaaatctctgcttggacacatgaatttgagggttgtgctctccactaacccaagaattcccatgctggggagggtagcttggccctccgcttgcttcccagttcatacagatggtcctttgctccctctatttctcaccttgttctaatgcctgtttctcaattattttgcctgaagtttcctggagaatgagggtgaggggagacctggagtgggagacctgggtgtggattactgtagcactaaggcaaaacaggattcctgcggaatagccaagtgcacatcaaaggcacctccaactccagtgcctcttcccggtccatgtcctgctccacccaaccttcaatcagggaacacaaacaacagcgaagtttgccaaaagaattcgagtatcagtgagatgttctggccagggtacaggagggatgagtgaggcagaaactatcaaagaaaactcatttccccacacccaagaaggagctggatgacccaggtacagatataattttgagatgggaaaattaagggattttaaagaaacagttccagcctcaacaagaagctagagaatgtggtgctcagtgaggggttatcctacttggaggcccagctggtctcccaggttcagccaaacacggaaatctcagatcctcggatgtcatgtggggtggggcagggaagtctcacatgtcttcagccctgcacaaggccaggagggctgactggcaatcccctttcactgcatcctgcagacaagggaattcagtgttagaaagatccaccaccactatggcccaagtgctctctcccctcctttgggctggtccatcacagttcatctgggagggaagggtcctcccgggagctcagagtcctgcactacattaaccaaagactcctgggttttcttttttaagatggagtcttgccctgtcacccaggtgggagtgcagtggcacgatcttggctcactgcaacctctgccttctgggttcaagcgactctcctgcctcagcctcctgagtagctgggattacaggtgcacgccaccatgcctggctaatttttgtatttttagtagagacggggtttcaccatgttggtcagggtggtcttgaactcctgacctcgtgatccgcccacctcagcctctcaaagtgctgggattacaggcgtgagccactgtgcctggctaactactgggttttctatggggcaagaatatgctcagctgtgtgcagggagtgagggtggaggtgaggagtgaaggcctgaggctccaggctaagaagtagccaagtttcacctggagagaagagtagagggacttcccaaatttcttcctgaactcagctctgatactcagaaggtcagtctcacatcgagagataaggatgcgaatcaggacttggtaattgggctcagtttcctagtaggggaagaaagagatggggggtagttagtgagagtctcactgagagtaggggttgaatggcttggagggttattgtaggaaggggaggcaaggtgggagtcaagggataagagtgtacattatacattatctcgggacaaaagttatgtttgtccatcctcaaggaagatgacacagcaggaaagatcagtctctgtgggggcagcttgagtatttatttctttccacatgtctttcctgcccctaccattagcttagagctgtgtacctccagaatttggtggtgagcagctccaaagataggtacaccaggaaggctagaaaagatttggtgcatataaagactgccagcatgaaaaccaggaaaactgcttttaactttcaagttagtgaatatccaaggaggatatacctgccctatccctaaactgagctgatgaggctctgatagggttcaaggttgtgtgacttctagttctgattccaacccaatagggccatctcacagccccatctctgcatattagtttctccggttggacccttaggctgaaacattgctatcttcctcctgtacatgcagcaggcctgttttttggctaaagaaagtaatgaaaggttcagtttagaaataacaggccaggcacagtggctcatgcctgtaatcccagcactttgggaggatgaggcgcgtggatcatctgaggtaggagttcgagaccagcctgaccaaaatggtgaaaccccgtctctactaaaaatacaaaaataagccaggcatggtggtgggtgcctgcantcccagctacttggaaggctgaggcaggagaattgcttgancccaggaggtggaggttgcagtgagctgagatcgcgccactgcactccaacctgggcaagaagagcaaaactccgtctcaaaaaaaaaaaaaaaaaagaaagaaagaaaaaagaaataacaggccaggtgtggtggctcatgcctgtaatcccagaattttgggaggccaaggcaagcagatcatttatggtcaggagttcgagaccagcctggccaacatggtgaaacccccgtctctattaaaactacaaaaattagccaggtgtggtggtaggcgcctataatcccagctactgaggagggtgaggtaggagaattgcttgaacctgggaggcggacgttgcagtgagctgagatcacaccactgcactccagcctgggacagagcaagactccgtctcaaaaaaaaagaaaagaaaagaaataacacaggtacaagtcatcaaaatcctgaattataattgattatactaagtaatgtgttgttatgagagatttttaaataaaaacttttaattgtaa

SEQ ID NO: 285562 - DNA, 2156 bp, Homo sapiens
gcgctccgtcccttctagaggcaggcagagggaagagaaagggtctgttgtttttctctcctgtttctcgctccctctctgctgatcacaaagctgctgaccgggtcagaaagtcctgatggaaatccaccagcgctgggcaggcccctcctcctccagggagcttgtccttgcctaatttttcttcgtcctgatgagaacaaaaaagagagagagaagaaaagaaaaaccacaaacttcctttgaaaaccagcttgtagtcagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaagcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaaagcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccacccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggcacggtggctcactcct

SEQ ID NO: 285563 - DNA, 4239 bp, Homo sapiens
  misc_feature (2694)..(2694): n is a, c, g, or t
gcgctccgtcccttctagaggcaggcagagggaagagaaagggtctgttgtttttctctcctgtttctcgctccctctctgctgatcacaaagctgctgaccgggtcagaaagtcctgatggaaatccaccagcgctgggcaggcccctcctcctccagggagcttgtccttgcctaatttttcttcgtcctgatgagaacaaaaaagagagagagaagaaaagaaaaaccacaaacttcctttgaaaaccagcttgtagtcagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaaggtcactcttttgcatcccaagcctggcttaggcaagtccctgaggttagtaaacaccttcagtgcccctcagccgagtcccttttgaccatggaataccatcagcctgaggatccagcccctggtaaggccgggactgcagaagcagtcatccctgaaaaccatgaggttctggcaggcccagatgagcaccctcaggacacagatgcaagagatgctgatggggaggctagagaacgggagccagcagaccaagctttgctgcctagccagtgtggggacaaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaaagcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccacccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggcacggtggctcactcctgtaatctcaacaatttgagaggccaaggtgggcggatcacctgaggttaggagttcgagaccagcctgcccaaaaaggtgaaaccccgtctctactaaaaatacaagaaattactgggactacaggcatgcgccactgcgcccagctantttttgtatttttagtagagacggtttcgccactttggtcaggctagtcttgaattcctgacctcaagtaatccgcctgccttggcctcccgaagtgctggaattacaggcgtgagccactgcgcccagctacctgtcatttctaatatagcctgcagggggaaccaaagcctgactttttgtttttgtttctgtttttgtttttgttttctatgggaaatagtgctctcctgggaggtgggtttccaaatctctgcttggacacatgaatttgagggttgtgctctccactaacccaagaattcccatgctggggagggtagcttggccctccgcttgcttcccagttcatacagatggtcctttgctccctctatttctcaccttgttctaatgcctgtttctcaattattttgcctgaagtttcctggagaatgagggtgaggggagacctggagtgggagacctgggtgtggattactgtagcactaaggcaaaacaggattcctgcggaatagccaagtgcacatcaaaggcacctccaactccagtgcctcttcccggtccatgtcctgctccacccaaccttcaatcagggaacacaaacaacagcgaagtttgccaaaagaattcgagtatcagtgagatgttctggccagggtacaggagggatgagtgaggcagaaactatcaaagaaaactcatttccccacacccaagaaggagctggatgacccaggtacagatataattttgagatgggaaaattaagggattttaaagaaacagttccagcctcaacaagaagctagagaatgtggtgctcagtgaggggttatcctacttggaggcccagctggtctcccaggttcagccaaacacggaaatctcagatcctcggatgtcatgtggggtggggcagggaagtctcacatgtcttcagccctgcacaaggccaggagggctgactggcaatcccctttcactgcatcctgcagacaagggaattcagtgttagaaagatccaccaccactatggcccaagtgctctctcccctcctttgggctggtccatcacagttcatctgggagggaagggtcctcccgggagctcagagtcctgcactacattaaccaaagactcctgggttttcttttttaagatggagtcttgccctgtcacccaggtgggagtgcagtggcacgatcttggctcactgcaacctctgccttctgggttcaagcgactctcctgcctcagcctcctgagtagctgggattacaggtgtggtggtaggcgcctataatcccagctactgaggagggtgaggtaggagaattgcttgaacctgggaggcggacgttgcagtgagctgagatcacaccactgcactccagcctgggacagagcaagactccgtctcaaaaaaaaagaaaagaaaagaaataacacaggtacaagtcatcaaaatcctgaattataattgattatactaagtaatgtgttgttatgagagatttttaaataaaaacttttaattgtaa

SEQ ID NO: 285564 - DNA, 4187 bp, Homo sapiens
  misc_feature (2694)..(2694): n is a, c, g, or t
gcgctccgtcccttctagaggcaggcagagggaagagaaagggtctgttgtttttctctcctgtttctcgctccctctctgctgatcacaaagctgctgaccgggtcagaaagtcctgatggaaatccaccagcgctgggcaggcccctcctcctccagggagcttgtccttgcctaatttttcttcgtcctgatgagaacaaaaaagagagagagaagaaaagaaaaaccacaaacttcctttgaaaaccagcttgtagtcagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaaggtcactcttttgcatcccaagcctggcttaggcaagtccctgaggttagtaaacaccttcagtgcccctcagccgagtcccttttgaccatggaataccatcagcctgaggatccagcccctggtaaggccgggactgcagaagcagtcatccctgaaaaccatgaggttctggcaggcccagatgagcaccctcaggacacagatgcaagagatgctgatggggaggctagagaacgggagccagcagaccaagctttgctgcctagccagtgtggggacaaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaaagcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccacccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggcacggtggctcactcctgtaatctcaacaatttgagaggccaaggtgggcggatcacctgaggttaggagttcgagaccagcctgcccaaaaaggtgaaaccccgtctctactaaaaatacaagaaattactgggactacaggcatgcgccactgcgcccagctantttttgtatttttagtagagacggtttcgccactttggtcaggctagtcttgaattcctgacctcaagtaatccgcctgccttggcctcccgaagtgctggaattacaggcgtgagccactgcgcccagctacctgtcatttctaatatagcctgcagggggaaccaaagcctgactttttgtttttgtttctgtttttgtttttgttttctatgggaaatagtgctctcctgggaggtgggtttccaaatctctgcttggacacatgaatttgagggttgtgctctccactaacccaagaattcccatgctggggagggtagcttggccctccgcttgcttcccagttcatacagatggtcctttgctccctctatttctcaccttgttctaatgcctgtttctcaattattttgcctgaagtttcctggagaatgagggtgaggggagacctggagtgggagacctgggtgtggattactgtagcactaaggcaaaacaggattcctgcggaatagccaagtgcacatcaaaggcacctccaactccagtgcctcttcccggtccatgtcctgctccacccaaccttcaatcagggaacacaaacaacagcgaagtttgccaaaagaattcgagtatcagtgagatgttctggccagggtacaggagggatgagtgaggcagaaactatcaaagaaaactcatttccccacacccaagaaggagctggatgacccaggtacagatataattttgagatgggaaaattaagggattttaaagaaacagttccagcctcaacaagaagctagagaatgtggtgctcagtgaggggttatcctacttggaggcccagctggtctcccaggttcagccaaacacggaaatctcagatcctcggatgtcatgtggggtggggcagggaagtctcacatgtcttcagccctgcacaaggccaggagggctgactggcaatcccctttcactgcatcctgcagacaagggaattcagtgttagaaagatccaccaccactatggcccaagtgctctctcccctcctttgggctggtccatcacagttcatctgggagggaagggtcctcccgggagctcagagtcctgcactacattaaccaaagactcctgggttttcttttttaagatggagtcttgccctgtcacccaggtgggagtgcagtggcacgatcttggctcactgcaacctctgccttctgggttcaagcgactctcctgcctcagctactgaggagggtgaggtaggagaattgcttgaacctgggaggcggacgttgcagtgagctgagatcacaccactgcactccagcctgggacagagcaagactccgtctcaaaaaaaaagaaaagaaaagaaataacacaggtacaagtcatcaaaatcctgaattataattgattatactaagtaatgtgttgttatgagagatttttaaataaaaacttttaattgtaa

SEQ ID NO: 285565 - DNA, 5143 bp, Homo sapiens
  misc_feature (2152)..(2152): n is a, c, g, or t
  misc_feature (4620)..(4620): n is a, c, g, or t
gcgctccgtcccttctagaggcaggcagagggaagagaaagggtctgttgtttttctctcctgtttctcgctccctctctgctgatcacaaagctgctgaccgggtcagaaagtcctgatggaaatccaccagcgctgggcaggcccctcctcctccagggagcttgtccttgcctaatttttcttcgtcctgatgagaacaaaaaagagagagagaagaaaagaaaaaccacaaacttcctttgaaaaccagcttgtagtcagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaaagcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccacccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggcacggtggctcactcctgtaatctcaacaatttgagaggccaaggtgggcggatcacctgaggttaggagttcgagaccagcctgcccaaaaaggtgaaaccccgtctctactaaaaatacaagaaattactgggactacaggcatgcgccactgcgcccagctantttttgtatttttagtagagacggtttcgccactttggtcaggctagtcttgaattcctgacctcaagtaatccgcctgccttggcctcccgaagtgctggaattacaggcgtgagccactgcgcccagctacctgtcatttctaatatagcctgcagggggaaccaaagcctgactttttgtttttgtttctgtttttgtttttgttttctatgggaaatagtgctctcctgggaggtgggtttccaaatctctgcttggacacatgaatttgagggttgtgctctccactaacccaagaattcccatgctggggagggtagcttggccctccgcttgcttcccagttcatacagatggtcctttgctccctctatttctcaccttgttctaatgcctgtttctcaattattttgcctgaagtttcctggagaatgagggtgaggggagacctggagtgggagacctgggtgtggattactgtagcactaaggcaaaacaggattcctgcggaatagccaagtgcacatcaaaggcacctccaactccagtgcctcttcccggtccatgtcctgctccacccaaccttcaatcagggaacacaaacaacagcgaagtttgccaaaagaattcgagtatcagtgagatgttctggccagggtacaggagggatgagtgaggcagaaactatcaaagaaaactcatttccccacacccaagaaggagctggatgacccaggtacagatataattttgagatgggaaaattaagggattttaaagaaacagttccagcctcaacaagaagctagagaatgtggtgctcagtgaggggttatcctacttggaggcccagctggtctcccaggttcagccaaacacggaaatctcagatcctcggatgtcatgtggggtggggcagggaagtctcacatgtcttcagccctgcacaaggccaggagggctgactggcaatcccctttcactgcatcctgcagacaagggaattcagtgttagaaagatccaccaccactatggcccaagtgctctctcccctcctttgggctggtccatcacagttcatctgggagggaagggtcctcccgggagctcagagtcctgcactacattaaccaaagactcctgggttttcttttttaagatggagtcttgccctgtcacccaggtgggagtgcagtggcacgatcttggctcactgcaacctctgccttctgggttcaagcgactctcctgcctcagcctcctgagtagctgggattacaggtgcacgccaccatgcctggctaatttttgtatttttagtagagacggggtttcaccatgttggtcagggtggtcttgaactcctgacctcgtgatccgcccacctcagcctctcaaagtgctgggattacaggcgtgagccactgtgcctggctaactactgggttttctatggggcaagaatatgctcagctgtgtgcagggagtgagggtggaggtgaggagtgaaggcctgaggctccaggctaagaagtagccaagtttcacctggagagaagagtagagggacttcccaaatttcttcctgaactcagctctgatactcagaaggtcagtctcacatcgagagataaggatgcgaatcaggacttggtaattgggctcagtttcctagtaggggaagaaagagatggggggtagttagtgagagtctcactgagagtaggggttgaatggcttggagggttattgtaggaaggggaggcaaggtgggagtcaagggataagagtgtacattatacattatctcgggacaaaagttatgtttgtccatcctcaaggaagatgacacagcaggaaagatcagtctctgtgggggcagcttgagtatttatttctttccacatgtctttcctgcccctaccattagcttagagctgtgtacctccagaatttggtggtgagcagctccaaagataggtacaccaggaaggctagaaaagatttggtgcatataaagactgccagcatgaaaaccaggaaaactgcttttaactttcaagttagtgaatatccaaggaggatatacctgccctatccctaaactgagctgatgaggctctgatagggttcaaggttgtgtgacttctagttctgattccaacccaatagggccatctcacagccccatctctgcatattagtttctccggttggacccttaggctgaaacattgctatcttcctcctgtacatgcagcaggcctgttttttggctaaagaaagtaatgaaaggttcagtttagaaataacaggccaggcacagtggctcatgcctgtaatcccagcactttgggaggatgaggcgcgtggatcatctgaggtaggagttcgagaccagcctgaccaaaatggtgaaaccccgtctctactaaaaatacatgaggcaggagaattgcttgancccaggaggtggaggttgcagtgagctgagatcgcgccactgcactccaacctgggcaagaagagcaaaactccgtctcaaaaaaaaaaaaaaaaaagaaagaaagaaaaaagaaataacaggccaggtgtggtggctcatgcctgtaatcccagaattttgggaggccaaggcaagcagatcatttatggtcaggagttcgagaccagcctggccaacatggtgaaacccccgtctctattaaaactacaaaaattagccaggtgtggtggtaggcgcctataatcccagctactgaggagggtgaggtaggagaattgcttgaacctgggaggcggacgttgcagtgagctgagatcacaccactgcactccagcctgggacagagcaagactccgtctcaaaaaaaaagaaaagaaaagaaataacacaggtacaagtcatcaaaatcctgaattataattgattatactaagtaatgtgttgttatgagagatttttaaataaaaacttttaattgtaa

SEQ ID NO: 285566 - DNA, 4984 bp, Homo sapiens
  misc_feature (1993)..(1993): n is a, c, g, or t
  misc_feature (4461)..(4461): n is a, c, g, or t
gcgctccgtcccttctagaggcaggcagagggaagagaaagggtctgttgtttttctctcctgtttctcgctccctctctgctgatcacaaagctgctgaccgggtcagaaagtcctgatggaaatccaccagcgctgggcaggcccctcctcctccagggagcttgtccttgcctaatttttcttcgtcctgatgagaacaaaaaagagagagagaagaaaagaaaaaccacaaacttcctttgaaaaccagcttgtagtcagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaaggtgaagctccccccgcagaaggaagtgatcacatcggatgagctcatggcccatcttggaaactgcctcctgtccatcaagccccaggagaagtcagagggacttcagcttaattttcagcagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaaagcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccacccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggcacggtggctcactcctgtaatctcaacaatttgagaggccaaggtgggcggatcacctgaggttaggagttcgagaccagcctgcccaaaaaggtgaaaccccgtctctactaaaaatacaagaaattactgggactacaggcatgcgccactgcgcccagctantttttgtatttttagtagagacggtttcgccactttggtcaggctagtcttgaattcctgacctcaagtaatccgcctgccttggcctcccgaagtgctggaattacaggcgtgagccactgcgcccagctacctgtcatttctaatatagcctgcagggggaaccaaagcctgactttttgtttttgtttctgtttttgtttttgttttctatgggaaatagtgctctcctgggaggtgggtttccaaatctctgcttggacacatgaatttgagggttgtgctctccactaacccaagaattcccatgctggggagggtagcttggccctccgcttgcttcccagttcatacagatggtcctttgctccctctatttctcaccttgttctaatgcctgtttctcaattattttgcctgaagtttcctggagaatgagggtgaggggagacctggagtgggagacctgggtgtggattactgtagcactaaggcaaaacaggattcctgcggaatagccaagtgcacatcaaaggcacctccaactccagtgcctcttcccggtccatgtcctgctccacccaaccttcaatcagggaacacaaacaacagcgaagtttgccaaaagaattcgagtatcagtgagatgttctggccagggtacaggagggatgagtgaggcagaaactatcaaagaaaactcatttccccacacccaagaaggagctggatgacccaggtacagatataattttgagatgggaaaattaagggattttaaagaaacagttccagcctcaacaagaagctagagaatgtggtgctcagtgaggggttatcctacttggaggcccagctggtctcccaggttcagccaaacacggaaatctcagatcctcggatgtcatgtggggtggggcagggaagtctcacatgtcttcagccctgcacaaggccaggagggctgactggcaatcccctttcactgcatcctgcagacaagggaattcagtgttagaaagatccaccaccactatggcccaagtgctctctcccctcctttgggctggtccatcacagttcatctgggagggaagggtcctcccgggagctcagagtcctgcactacattaaccaaagactcctgggttttcttttttaagatggagtcttgccctgtcacccaggtgggagtgcagtggcacgatcttggctcactgcaacctctgccttctgggttcaagcgactctcctgcctcagcctcctgagtagctgggattacaggtgcacgccaccatgcctggctaatttttgtatttttagtagagacggggtttcaccatgttggtcagggtggtcttgaactcctgacctcgtgatccgcccacctcagcctctcaaagtgctgggattacaggcgtgagccactgtgcctggctaactactgggttttctatggggcaagaatatgctcagctgtgtgcagggagtgagggtggaggtgaggagtgaaggcctgaggctccaggctaagaagtagccaagtttcacctggagagaagagtagagggacttcccaaatttcttcctgaactcagctctgatactcagaaggtcagtctcacatcgagagataaggatgcgaatcaggacttggtaattgggctcagtttcctagtaggggaagaaagagatggggggtagttagtgagagtctcactgagagtaggggttgaatggcttggagggttattgtaggaaggggaggcaaggtgggagtcaagggataagagtgtacattatacattatctcgggacaaaagttatgtttgtccatcctcaaggaagatgacacagcaggaaagatcagtctctgtgggggcagcttgagtatttatttctttccacatgtctttcctgcccctaccattagcttagagctgtgtacctccagaatttggtggtgagcagctccaaagataggtacaccaggaaggctagaaaagatttggtgcatataaagactgccagcatgaaaaccaggaaaactgcttttaactttcaagttagtgaatatccaaggaggatatacctgccctatccctaaactgagctgatgaggctctgatagggttcaaggttgtgtgacttctagttctgattccaacccaatagggccatctcacagccccatctctgcatattagtttctccggttggacccttaggctgaaacattgctatcttcctcctgtacatgcagcaggcctgttttttggctaaagaaagtaatgaaaggttcagtttagaaataacaggccaggcacagtggctcatgcctgtaatcccagcactttgggaggatgaggcgcgtggatcatctgaggtaggagttcgagaccagcctgaccaaaatggtgaaaccccgtctctactaaaaatacatgaggcaggagaattgcttgancccaggaggtggaggttgcagtgagctgagatcgcgccactgcactccaacctgggcaagaagagcaaaactccgtctcaaaaaaaaaaaaaaaaaagaaagaaagaaaaaagaaataacaggccaggtgtggtggctcatgcctgtaatcccagaattttgggaggccaaggcaagcagatcatttatggtcaggagttcgagaccagcctggccaacatggtgaaacccccgtctctattaaaactacaaaaattagccaggtgtggtggtaggcgcctataatcccagctactgaggagggtgaggtaggagaattgcttgaacctgggaggcggacgttgcagtgagctgagatcacaccactgcactccagcctgggacagagcaagactccgtctcaaaaaaaaagaaaagaaaagaaataacacaggtacaagtcatcaaaatcctgaattataattgattatactaagtaatgtgttgttatgagagatttttaaataaaaacttttaattgtaa

SEQ ID NO: 285567 - DNA, 2208 bp, Homo sapiens
gcgctccgtcccttctagaggcaggcagagggaagagaaagggtctgttgtttttctctcctgtttctcgctccctctctgctgatcacaaagctgctgaccgggtcagaaagtcctgatggaaatccaccagcgctgggcaggcccctcctcctccagggagcttgtccttgcctaatttttcttcgtcctgatgagaacaaaaaagagagagagaagaaaagaaaaaccacaaacttcctttgaaaaccagcttgtagtcagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaaggtcactcttttgcatcccaagcctggcttaggcaagtccctgaggttagtaaacaccttcagtgcccctcagccgagtcccttttgaccatggaataccatcagcctgaggatccagcccctggtaaggccgggactgcagaagcagtcatccctgaaaaccatgaggttctggcaggcccagatgagcaccctcaggacacagatgcaagagatgctgatggggaggctagagaacgggagccagcagaccaagctttgctgcctagccagtgtggggacaaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaaagcagctgcaggtagaccaggtgtgtagggcacttaggaaaagtgcagagagcacatgtgcctcagagagctttttactgcatacattttaactgctagaggccatgtgaacccatgcctctctctctgggttacctcagaccgtctcctcacttggtgtgtattctctggcaccacagataatgcatttggctgtgtgtgctgctctgtggggagaaagagctagagaatttgagggatgtgggaaaactgatttggaaaccttgcctgaatagccacggctctgggcctcagcccactgcacaactcttgttctccccaggactacctgattgctctgtccctgcagcagctggtggcctaatcgtcgtacctgcaggctagcaa

SEQ ID NO: 285568 - DNA, 4461 bp, Homo sapiens
  misc_feature (1470)..(1470): n is a, c, g, or t
  misc_feature (3938)..(3938): n is a, c, g, or t
gatgacagagcgagactccatctccaagaaaaaaaatgtccacatgctcataccgagatttctggcagtgaactgcctccgtatcaactgtccccccaatgagctctgttcttttctttgtagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaaagcagctgcaggtagaccaggtgtgtagggcacttaggaaaagtgcagagagcacatgtgcctcagagagctttttactgcatacattttaactgctagaggccatgtgaacccatgcctctctctctgggttacctcagaccgtctcctcacttggtgtgtattctctggcaccacagataatgcatttggctgtgtgtgctgctctgtggggagaaagagctagagaatttgagggatgtgggaaaactgatttggaaaccttgcctgaatagccacggctctgggcctcagcccactgcacaactcttgttctccccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccacccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggcacggtggctcactcctgtaatctcaacaatttgagaggccaaggtgggcggatcacctgaggttaggagttcgagaccagcctgcccaaaaaggtgaaaccccgtctctactaaaaatacaagaaattactgggactacaggcatgcgccactgcgcccagctantttttgtatttttagtagagacggtttcgccactttggtcaggctagtcttgaattcctgacctcaagtaatccgcctgccttggcctcccgaagtgctggaattacaggcgtgagccactgcgcccagctacctgtcatttctaatatagcctgcagggggaaccaaagcctgactttttgtttttgtttctgtttttgtttttgttttctatgggaaatagtgctctcctgggaggtgggtttccaaatctctgcttggacacatgaatttgagggttgtgctctccactaacccaagaattcccatgctggggagggtagcttggccctccgcttgcttcccagttcatacagatggtcctttgctccctctatttctcaccttgttctaatgcctgtttctcaattattttgcctgaagtttcctggagaatgagggtgaggggagacctggagtgggagacctgggtgtggattactgtagcactaaggcaaaacaggattcctgcggaatagccaagtgcacatcaaaggcacctccaactccagtgcctcttcccggtccatgtcctgctccacccaaccttcaatcagggaacacaaacaacagcgaagtttgccaaaagaattcgagtatcagtgagatgttctggccagggtacaggagggatgagtgaggcagaaactatcaaagaaaactcatttccccacacccaagaaggagctggatgacccaggtacagatataattttgagatgggaaaattaagggattttaaagaaacagttccagcctcaacaagaagctagagaatgtggtgctcagtgaggggttatcctacttggaggcccagctggtctcccaggttcagccaaacacggaaatctcagatcctcggatgtcatgtggggtggggcagggaagtctcacatgtcttcagccctgcacaaggccaggagggctgactggcaatcccctttcactgcatcctgcagacaagggaattcagtgttagaaagatccaccaccactatggcccaagtgctctctcccctcctttgggctggtccatcacagttcatctgggagggaagggtcctcccgggagctcagagtcctgcactacattaaccaaagactcctgggttttcttttttaagatggagtcttgccctgtcacccaggtgggagtgcagtggcacgatcttggctcactgcaacctctgccttctgggttcaagcgactctcctgcctcagcctcctgagtagctgggattacaggtgcacgccaccatgcctggctaatttttgtatttttagtagagacggggtttcaccatgttggtcagggtggtcttgaactcctgacctcgtgatccgcccacctcagcctctcaaagtgctgggattacaggcgtgagccactgtgcctggctaactactgggttttctatggggcaagaatatgctcagctgtgtgcagggagtgagggtggaggtgaggagtgaaggcctgaggctccaggctaagaagtagccaagtttcacctggagagaagagtagagggacttcccaaatttcttcctgaactcagctctgatactcagaaggtcagtctcacatcgagagataaggatgcgaatcaggacttggtaattgggctcagtttcctagtaggggaagaaagagatggggggtagttagtgagagtctcactgagagtaggggttgaatggcttggagggttattgtaggaaggggaggcaaggtgggagtcaagggataagagtgtacattatacattatctcgggacaaaagttatgtttgtccatcctcaaggaagatgacacagcaggaaagatcagtctctgtgggggcagcttgagtatttatttctttccacatgtctttcctgcccctaccattagcttagagctgtgtacctccagaatttggtggtgagcagctccaaagataggtacaccaggaaggctagaaaagatttggtgcatataaagactgccagcatgaaaaccaggaaaactgcttttaactttcaagttagtgaatatccaaggaggatatacctgccctatccctaaactgagctgatgaggctctgatagggttcaaggttgtgtgacttctagttctgattccaacccaatagggccatctcacagccccatctctgcatattagtttctccggttggacccttaggctgaaacattgctatcttcctcctgtacatgcagcaggcctgttttttggctaaagaaagtaatgaaaggttcagtttagaaataacaggccaggcacagtggctcatgcctgtaatcccagcactttgggaggatgaggcgcgtggatcatctgaggtaggagttcgagaccagcctgaccaaaatggtgaaaccccgtctctactaaaaatacatgaggcaggagaattgcttgancccaggaggtggaggttgcagtgagctgagatcgcgccactgcactccaacctgggcaagaagagcaaaactccgtctcaaaaaaaaaaaaaaaaaagaaagaaagaaaaaagaaataacaggccaggtgtggtggctcatgcctgtaatcccagaattttgggaggccaaggcaagcagatcatttatggtcaggagttcgagaccagcctggccaacatggtgaaacccccgtctctattaaaactacaaaaattagccaggtgtggtggtaggcgcctataatcccagctactgaggagggtgaggtaggagaattgcttgaacctgggaggcggacgttgcagtgagctgagatcacaccactgcactccagcctgggacagagcaagactccgtctcaaaaaaaaagaaaagaaaagaaataacacaggtacaagtcatcaaaatcctgaattataattgattatactaagtaatgtgttgttatgagagatttttaaataaaaacttttaattgtaa

SEQ ID NO: 285569 - DNA, 349 bp, Homo sapiens
tagctgctctattataagtatttgttaagtgaatgaatacagccaggtttcaagaaagggacgtcagaaggtgggactgaccccccggggcttttgacaggggctctctggatggtccttcctgttgtggaccttgaatttaagccaagtttcccccgactcgtccctttctggcaggcctgattgcagagcagttcctggagaccaccgcggcccagctgacctaccacggactgtgtgagctgacagcagctgctaaggagggtgaacttagcgtctttttccgaaacaaccactttagcaccatgactaagcataaggtaatgcgagtttgggggtggcgtgctgc

SEQ ID NO: 285570 - DNA, 499 bp, Homo sapiens
ggtaaggccgggactgcagaagcagtcatccctgaaaaccatgaggttctggcaggcccagatgagcaccctcaggacacagatgcaagagatgctgatggggaggctagagaacgggagccagcagaccaagctttgctgcctagccagtgtggggacaaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtaagagaacatgcagttaggggtgcaaaaaatatcagggagtactcttccctgacttacttccttgatcatcctgatg

SEQ ID NO: 285571 - DNA, 6000 bp, Homo sapiens
  misc_feature (2956)..(2956): n is a, c, g, or t
  misc_feature (5436)..(5436): n is a, c, g, or t
  misc_feature (5477)..(5477): n is a, c, g, or t
gcgctccgtcccttctagaggcaggcagagggaagagaaagggtctgttgtttttctctcctgtttctcgctccctctctgctgatcacaaagctgctgaccgggtcagaaagtcctgatggaaatccaccagcgctgggcaggcccctcctcctccagggagcttgtccttgcctaatttttcttcgtcctgatgagaacaaaaaagagagagagaagaaaagaaaaaccacaaacttcctttgaaaaccagcttgtagtcagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaagggaagctgactccacccatgtgttcaatcccaccagtcttccctcccaagtctggaagccccacgacctcttggtctcatctggtcacagcaagttagaggtggaaagagctcagcacggggcccttctgtttacacatatactgcccatagccaggagttactgcacaaacactagccagccttctacactacattccttttccaagacttttctgggttagtttgctttccagcccactgatttccttcttattggacaggtcactcttttgcatcccaagcctggcttaggcaagtccctgaggttagtaaacaccttcagtgcccctcagccgagtcccttttgaccatggaataccatcagcctgaggatccagcccctggtaaggccgggactgcagaagcagtcatccctgaaaaccatgaggttctggcaggcccagatgagcaccctcaggacacagatgcaagagatgctgatggggaggctagagaacgggagccagcagaccaagctttgctgcctagccagtgtggggacaaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaaagcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccacccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggcacggtggctcactcctgtaatctcaacaatttgagaggccaaggtgggcggatcacctgaggttaggagttcgagaccagcctgcccaaaaaggtgaaaccccgtctctactaaaaatacaagaaattactgggactacaggcatgcgccactgcgcccagctantttttgtatttttagtagagacggtttcgccactttggtcaggctagtcttgaattcctgacctcaagtaatccgcctgccttggcctcccgaagtgctggaattacaggcgtgagccactgcgcccagctacctgtcatttctaatatagcctgcagggggaaccaaagcctgactttttgtttttgtttctgtttttgtttttgttttctatgggaaatagtgctctcctgggaggtgggtttccaaatctctgcttggacacatgaatttgagggttgtgctctccactaacccaagaattcccatgctggggagggtagcttggccctccgcttgcttcccagttcatacagatggtcctttgctccctctatttctcaccttgttctaatgcctgtttctcaattattttgcctgaagtttcctggagaatgagggtgaggggagacctggagtgggagacctgggtgtggattactgtagcactaaggcaaaacaggattcctgcggaatagccaagtgcacatcaaaggcacctccaactccagtgcctcttcccggtccatgtcctgctccacccaaccttcaatcagggaacacaaacaacagcgaagtttgccaaaagaattcgagtatcagtgagatgttctggccagggtacaggagggatgagtgaggcagaaactatcaaagaaaactcatttccccacacccaagaaggagctggatgacccaggtacagatataattttgagatgggaaaattaagggattttaaagaaacagttccagcctcaacaagaagctagagaatgtggtgctcagtgaggggttatcctacttggaggcccagctggtctcccaggttcagccaaacacggaaatctcagatcctcggatgtcatgtggggtggggcagggaagtctcacatgtcttcagccctgcacaaggccaggagggctgactggcaatcccctttcactgcatcctgcagacaagggaattcagtgttagaaagatccaccaccactatggcccaagtgctctctcccctcctttgggctggtccatcacagttcatctgggagggaagggtcctcccgggagctcagagtcctgcactacattaaccaaagactcctgggttttcttttttaagatggagtcttgccctgtcacccaggtgggagtgcagtggcacgatcttggctcactgcaacctctgccttctgggttcaagcgactctcctgcctcagcctcctgagtagctgggattacaggtgcacgccaccatgcctggctaatttttgtatttttagtagagacggggtttcaccatgttggtcagggtggtcttgaactcctgacctcgtgatccgcccacctcagcctctcaaagtgctgggattacaggcgtgagccactgtgcctggctaactactgggttttctatggggcaagaatatgctcagctgtgtgcagggagtgagggtggaggtgaggagtgaaggcctgaggctccaggctaagaagtagccaagtttcacctggagagaagagtagagggacttcccaaatttcttcctgaactcagctctgatactcagaaggtcagtctcacatcgagagataaggatgcgaatcaggacttggtaattgggctcagtttcctagtaggggaagaaagagatggggggtagttagtgagagtctcactgagagtaggggttgaatggcttggagggttattgtaggaaggggaggcaaggtgggagtcaagggataagagtgtacattatacattatctcgggacaaaagttatgtttgtccatcctcaaggaagatgacacagcaggaaagatcagtctctgtgggggcagcttgagtatttatttctttccacatgtctttcctgcccctaccattagcttagagctgtgtacctccagaatttggtggtgagcagctccaaagataggtacaccaggaaggctagaaaagatttggtgcatataaagactgccagcatgaaaaccaggaaaactgcttttaactttcaagttagtgaatatccaaggaggatatacctgccctatccctaaactgagctgatgaggctctgatagggttcaaggttgtgtgacttctagttctgattccaacccaatagggccatctcacagccccatctctgcatattagtttctccggttggacccttaggctgaaacattgctatcttcctcctgtacatgcagcaggcctgttttttggctaaagaaagtaatgaaaggttcagtttagaaataacaggccaggcacagtggctcatgcctgtaatcccagcactttgggaggatgaggcgcgtggatcatctgaggtaggagttcgagaccagcctgaccaaaatggtgaaaccccgtctctactaaaaatacaaaaataagccaggcatggtggtgggtgcctgcantcccagctacttggaaggctgaggcaggagaattgcttgancccaggaggtggaggttgcagtgagctgagatcgcgccactgcactccaacctgggcaagaagagcaaaactccgtctcaaaaaaaaaaaaaaaaaagaaagaaagaaaaaagaaataacaggccaggtgtggtggctcatgcctgtaatcccagaattttgggaggccaaggcaagcagatcatttatggtcaggagttcgagaccagcctggccaacatggtgaaacccccgtctctattaaaactacaaaaattagccaggtgtggtggtaggcgcctataatcccagctactgaggagggtgaggtaggagaattgcttgaacctgggaggcggacgttgcagtgagctgagatcacaccactgcactccagcctgggacagagcaagactccgtctcaaaaaaaaagaaaagaaaagaaataacacaggtacaagtcatcaaaatcctgaattataattgattatactaagtaatgtgttgttatgagagatttttaaataaaaacttttaattgtaa

SEQ ID NO: 285572 - DNA, 6025 bp, Homo sapiens
  misc_feature (2981)..(2981): n is a, c, g, or t
  misc_feature (5461)..(5461): n is a, c, g, or t
  misc_feature (5502)..(5502): n is a, c, g, or t
ggccaagggggcgtggcgtggggcgacgtgggaaacgtagtcccgcaactccgcaatgtccctagcaaccgagggaaggattgttttctgagggatcagtcgttcggtaaacaaatgtctgctgaccgggtcagaaagtcctgatggaaatccaccagcgctgggcaggcccctcctcctccagggagcttgtccttgcctaatttttcttcgtcctgatgagaacaaaaaagagagagagaagaaaagaaaaaccacaaacttcctttgaaaaccagcttgtagtcagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaagggaagctgactccacccatgtgttcaatcccaccagtcttccctcccaagtctggaagccccacgacctcttggtctcatctggtcacagcaagttagaggtggaaagagctcagcacggggcccttctgtttacacatatactgcccatagccaggagttactgcacaaacactagccagccttctacactacattccttttccaagacttttctgggttagtttgctttccagcccactgatttccttcttattggacaggtcactcttttgcatcccaagcctggcttaggcaagtccctgaggttagtaaacaccttcagtgcccctcagccgagtcccttttgaccatggaataccatcagcctgaggatccagcccctggtaaggccgggactgcagaagcagtcatccctgaaaaccatgaggttctggcaggcccagatgagcaccctcaggacacagatgcaagagatgctgatggggaggctagagaacgggagccagcagaccaagctttgctgcctagccagtgtggggacaaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaaagcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccacccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggcacggtggctcactcctgtaatctcaacaatttgagaggccaaggtgggcggatcacctgaggttaggagttcgagaccagcctgcccaaaaaggtgaaaccccgtctctactaaaaatacaagaaattactgggactacaggcatgcgccactgcgcccagctantttttgtatttttagtagagacggtttcgccactttggtcaggctagtcttgaattcctgacctcaagtaatccgcctgccttggcctcccgaagtgctggaattacaggcgtgagccactgcgcccagctacctgtcatttctaatatagcctgcagggggaaccaaagcctgactttttgtttttgtttctgtttttgtttttgttttctatgggaaatagtgctctcctgggaggtgggtttccaaatctctgcttggacacatgaatttgagggttgtgctctccactaacccaagaattcccatgctggggagggtagcttggccctccgcttgcttcccagttcatacagatggtcctttgctccctctatttctcaccttgttctaatgcctgtttctcaattattttgcctgaagtttcctggagaatgagggtgaggggagacctggagtgggagacctgggtgtggattactgtagcactaaggcaaaacaggattcctgcggaatagccaagtgcacatcaaaggcacctccaactccagtgcctcttcccggtccatgtcctgctccacccaaccttcaatcagggaacacaaacaacagcgaagtttgccaaaagaattcgagtatcagtgagatgttctggccagggtacaggagggatgagtgaggcagaaactatcaaagaaaactcatttccccacacccaagaaggagctggatgacccaggtacagatataattttgagatgggaaaattaagggattttaaagaaacagttccagcctcaacaagaagctagagaatgtggtgctcagtgaggggttatcctacttggaggcccagctggtctcccaggttcagccaaacacggaaatctcagatcctcggatgtcatgtggggtggggcagggaagtctcacatgtcttcagccctgcacaaggccaggagggctgactggcaatcccctttcactgcatcctgcagacaagggaattcagtgttagaaagatccaccaccactatggcccaagtgctctctcccctcctttgggctggtccatcacagttcatctgggagggaagggtcctcccgggagctcagagtcctgcactacattaaccaaagactcctgggttttcttttttaagatggagtcttgccctgtcacccaggtgggagtgcagtggcacgatcttggctcactgcaacctctgccttctgggttcaagcgactctcctgcctcagcctcctgagtagctgggattacaggtgcacgccaccatgcctggctaatttttgtatttttagtagagacggggtttcaccatgttggtcagggtggtcttgaactcctgacctcgtgatccgcccacctcagcctctcaaagtgctgggattacaggcgtgagccactgtgcctggctaactactgggttttctatggggcaagaatatgctcagctgtgtgcagggagtgagggtggaggtgaggagtgaaggcctgaggctccaggctaagaagtagccaagtttcacctggagagaagagtagagggacttcccaaatttcttcctgaactcagctctgatactcagaaggtcagtctcacatcgagagataaggatgcgaatcaggacttggtaattgggctcagtttcctagtaggggaagaaagagatggggggtagttagtgagagtctcactgagagtaggggttgaatggcttggagggttattgtaggaaggggaggcaaggtgggagtcaagggataagagtgtacattatacattatctcgggacaaaagttatgtttgtccatcctcaaggaagatgacacagcaggaaagatcagtctctgtgggggcagcttgagtatttatttctttccacatgtctttcctgcccctaccattagcttagagctgtgtacctccagaatttggtggtgagcagctccaaagataggtacaccaggaaggctagaaaagatttggtgcatataaagactgccagcatgaaaaccaggaaaactgcttttaactttcaagttagtgaatatccaaggaggatatacctgccctatccctaaactgagctgatgaggctctgatagggttcaaggttgtgtgacttctagttctgattccaacccaatagggccatctcacagccccatctctgcatattagtttctccggttggacccttaggctgaaacattgctatcttcctcctgtacatgcagcaggcctgttttttggctaaagaaagtaatgaaaggttcagtttagaaataacaggccaggcacagtggctcatgcctgtaatcccagcactttgggaggatgaggcgcgtggatcatctgaggtaggagttcgagaccagcctgaccaaaatggtgaaaccccgtctctactaaaaatacaaaaataagccaggcatggtggtgggtgcctgcantcccagctacttggaaggctgaggcaggagaattgcttgancccaggaggtggaggttgcagtgagctgagatcgcgccactgcactccaacctgggcaagaagagcaaaactccgtctcaaaaaaaaaaaaaaaaaagaaagaaagaaaaaagaaataacaggccaggtgtggtggctcatgcctgtaatcccagaattttgggaggccaaggcaagcagatcatttatggtcaggagttcgagaccagcctggccaacatggtgaaacccccgtctctattaaaactacaaaaattagccaggtgtggtggtaggcgcctataatcccagctactgaggagggtgaggtaggagaattgcttgaacctgggaggcggacgttgcagtgagctgagatcacaccactgcactccagcctgggacagagcaagactccgtctcaaaaaaaaagaaaagaaaagaaataacacaggtacaagtcatcaaaatcctgaattataattgattatactaagtaatgtgttgttatgagagatttttaaataaaaacttttaattgtaa

SEQ ID NO: 285573 - DNA, 5685 bp, Homo sapiens
  misc_feature (2694)..(2694): n is a, c, g, or t
  misc_feature (5162)..(5162): n is a, c, g, or t
gcgctccgtcccttctagaggcaggcagagggaagagaaagggtctgttgtttttctctcctgtttctcgctccctctctgctgatcacaaagctgctgaccgggtcagaaagtcctgatggaaatccaccagcgctgggcaggcccctcctcctccagggagcttgtccttgcctaatttttcttcgtcctgatgagaacaaaaaagagagagagaagaaaagaaaaaccacaaacttcctttgaaaaccagcttgtagtcagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaaggtcactcttttgcatcccaagcctggcttaggcaagtccctgaggttagtaaacaccttcagtgcccctcagccgagtcccttttgaccatggaataccatcagcctgaggatccagcccctggtaaggccgggactgcagaagcagtcatccctgaaaaccatgaggttctggcaggcccagatgagcaccctcaggacacagatgcaagagatgctgatggggaggctagagaacgggagccagcagaccaagctttgctgcctagccagtgtggggacaaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaaagcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccacccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggcacggtggctcactcctgtaatctcaacaatttgagaggccaaggtgggcggatcacctgaggttaggagttcgagaccagcctgcccaaaaaggtgaaaccccgtctctactaaaaatacaagaaattactgggactacaggcatgcgccactgcgcccagctantttttgtatttttagtagagacggtttcgccactttggtcaggctagtcttgaattcctgacctcaagtaatccgcctgccttggcctcccgaagtgctggaattacaggcgtgagccactgcgcccagctacctgtcatttctaatatagcctgcagggggaaccaaagcctgactttttgtttttgtttctgtttttgtttttgttttctatgggaaatagtgctctcctgggaggtgggtttccaaatctctgcttggacacatgaatttgagggttgtgctctccactaacccaagaattcccatgctggggagggtagcttggccctccgcttgcttcccagttcatacagatggtcctttgctccctctatttctcaccttgttctaatgcctgtttctcaattattttgcctgaagtttcctggagaatgagggtgaggggagacctggagtgggagacctgggtgtggattactgtagcactaaggcaaaacaggattcctgcggaatagccaagtgcacatcaaaggcacctccaactccagtgcctcttcccggtccatgtcctgctccacccaaccttcaatcagggaacacaaacaacagcgaagtttgccaaaagaattcgagtatcagtgagatgttctggccagggtacaggagggatgagtgaggcagaaactatcaaagaaaactcatttccccacacccaagaaggagctggatgacccaggtacagatataattttgagatgggaaaattaagggattttaaagaaacagttccagcctcaacaagaagctagagaatgtggtgctcagtgaggggttatcctacttggaggcccagctggtctcccaggttcagccaaacacggaaatctcagatcctcggatgtcatgtggggtggggcagggaagtctcacatgtcttcagccctgcacaaggccaggagggctgactggcaatcccctttcactgcatcctgcagacaagggaattcagtgttagaaagatccaccaccactatggcccaagtgctctctcccctcctttgggctggtccatcacagttcatctgggagggaagggtcctcccgggagctcagagtcctgcactacattaaccaaagactcctgggttttcttttttaagatggagtcttgccctgtcacccaggtgggagtgcagtggcacgatcttggctcactgcaacctctgccttctgggttcaagcgactctcctgcctcagcctcctgagtagctgggattacaggtgcacgccaccatgcctggctaatttttgtatttttagtagagacggggtttcaccatgttggtcagggtggtcttgaactcctgacctcgtgatccgcccacctcagcctctcaaagtgctgggattacaggcgtgagccactgtgcctggctaactactgggttttctatggggcaagaatatgctcagctgtgtgcagggagtgagggtggaggtgaggagtgaaggcctgaggctccaggctaagaagtagccaagtttcacctggagagaagagtagagggacttcccaaatttcttcctgaactcagctctgatactcagaaggtcagtctcacatcgagagataaggatgcgaatcaggacttggtaattgggctcagtttcctagtaggggaagaaagagatggggggtagttagtgagagtctcactgagagtaggggttgaatggcttggagggttattgtaggaaggggaggcaaggtgggagtcaagggataagagtgtacattatacattatctcgggacaaaagttatgtttgtccatcctcaaggaagatgacacagcaggaaagatcagtctctgtgggggcagcttgagtatttatttctttccacatgtctttcctgcccctaccattagcttagagctgtgtacctccagaatttggtggtgagcagctccaaagataggtacaccaggaaggctagaaaagatttggtgcatataaagactgccagcatgaaaaccaggaaaactgcttttaactttcaagttagtgaatatccaaggaggatatacctgccctatccctaaactgagctgatgaggctctgatagggttcaaggttgtgtgacttctagttctgattccaacccaatagggccatctcacagccccatctctgcatattagtttctccggttggacccttaggctgaaacattgctatcttcctcctgtacatgcagcaggcctgttttttggctaaagaaagtaatgaaaggttcagtttagaaataacaggccaggcacagtggctcatgcctgtaatcccagcactttgggaggatgaggcgcgtggatcatctgaggtaggagttcgagaccagcctgaccaaaatggtgaaaccccgtctctactaaaaatacatgaggcaggagaattgcttgancccaggaggtggaggttgcagtgagctgagatcgcgccactgcactccaacctgggcaagaagagcaaaactccgtctcaaaaaaaaaaaaaaaaaagaaagaaagaaaaaagaaataacaggccaggtgtggtggctcatgcctgtaatcccagaattttgggaggccaaggcaagcagatcatttatggtcaggagttcgagaccagcctggccaacatggtgaaacccccgtctctattaaaactacaaaaattagccaggtgtggtggtaggcgcctataatcccagctactgaggagggtgaggtaggagaattgcttgaacctgggaggcggacgttgcagtgagctgagatcacaccactgcactccagcctgggacagagcaagactccgtctcaaaaaaaaagaaaagaaaagaaataacacaggtacaagtcatcaaaatcctgaattataattgattatactaagtaatgtgttgttatgagagatttttaaataaaaacttttaattgtaa

SEQ ID NO: 285574 - DNA, 4297 bp, Homo sapiens
  misc_feature (2694)..(2694): n is a, c, g, or t
gcgctccgtcccttctagaggcaggcagagggaagagaaagggtctgttgtttttctctcctgtttctcgctccctctctgctgatcacaaagctgctgaccgggtcagaaagtcctgatggaaatccaccagcgctgggcaggcccctcctcctccagggagcttgtccttgcctaatttttcttcgtcctgatgagaacaaaaaagagagagagaagaaaagaaaaaccacaaacttcctttgaaaaccagcttgtagtcagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaaggtcactcttttgcatcccaagcctggcttaggcaagtccctgaggttagtaaacaccttcagtgcccctcagccgagtcccttttgaccatggaataccatcagcctgaggatccagcccctggtaaggccgggactgcagaagcagtcatccctgaaaaccatgaggttctggcaggcccagatgagcaccctcaggacacagatgcaagagatgctgatggggaggctagagaacgggagccagcagaccaagctttgctgcctagccagtgtggggacaaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaaagcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccacccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggcacggtggctcactcctgtaatctcaacaatttgagaggccaaggtgggcggatcacctgaggttaggagttcgagaccagcctgcccaaaaaggtgaaaccccgtctctactaaaaatacaagaaattactgggactacaggcatgcgccactgcgcccagctantttttgtatttttagtagagacggtttcgccactttggtcaggctagtcttgaattcctgacctcaagtaatccgcctgccttggcctcccgaagtgctggaattacaggcgtgagccactgcgcccagctacctgtcatttctaatatagcctgcagggggaaccaaagcctgactttttgtttttgtttctgtttttgtttttgttttctatgggaaatagtgctctcctgggaggtgggtttccaaatctctgcttggacacatgaatttgagggttgtgctctccactaacccaagaattcccatgctggggagggtagcttggccctccgcttgcttcccagttcatacagatggtcctttgctccctctatttctcaccttgttctaatgcctgtttctcaattattttgcctgaagtttcctggagaatgagggtgaggggagacctggagtgggagacctgggtgtggattactgtagcactaaggcaaaacaggattcctgcggaatagccaagtgcacatcaaaggcacctccaactccagtgcctcttcccggtccatgtcctgctccacccaaccttcaatcagggaacacaaacaacagcgaagtttgccaaaagaattcgagtatcagtgagatgttctggccagggtacaggagggatgagtgaggcagaaactatcaaagaaaactcatttccccacacccaagaaggagctggatgacccaggtacagatataattttgagatgggaaaattaagggattttaaagaaacagttccagcctcaacaagaagctagagaatgtggtgctcagtgaggggttatcctacttggaggcccagctggtctcccaggttcagccaaacacggaaatctcagatcctcggatgtcatgtggggtggggcagggaagtctcacatgtcttcagccctgcacaaggccaggagggctgactggcaatcccctttcactgcatcctgcagacaagggaattcagtgttagaaagatccaccaccactatggcccaagtgctctctcccctcctttgggctggtccatcacagttcatctgggagggaagggtcctcccgggagctcagagtctgcactccaacctgggcaagaagagcaaaactccgtctcaaaaaaaaaaaaaaaaaagaaagaaagaaaaaagaaataacaggccaggtgtggtggctcatgcctgtaatcccagaattttgggaggccaaggcaagcagatcatttatggtcaggagttcgagaccagcctggccaacatggtgaaacccccgtctctattaaaactacaaaaattagccaggtgtggtggtaggcgcctataatcccagctactgaggagggtgaggtaggagaattgcttgaacctgggaggcggacgttgcagtgagctgagatcacaccactgcactccagcctgggacagagcaagactccgtctcaaaaaaaaagaaaagaaaagaaataacacaggtacaagtcatcaaaatcctgaattataattgattatactaagtaatgtgttgttatgagagatttttaaataaaaacttttaattgtaa

SEQ ID NO: 285575 - DNA, 2572 bp, Homo sapiens
  misc_feature (2563)..(2563): n is a, c, g, or t
gcgctccgtcccttctagaggcaggcagagggaagagaaagggtctgttgtttttctctcctgtttctcgctccctctctgctgatcacaaagctgctgaccgggtcagaaagtcctgatggaaatccaccagcgctgggcaggcccctcctcctccagggagcttgtccttgcctaatttttcttcgtcctgatgagaacaaaaaagagagagagaagaaaagaaaaaccacaaacttcctttgaaaaccagcttgtagtcagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaaggtcactcttttgcatcccaagcctggcttaggcaagtccctgaggttagtaaacaccttcagtgcccctcagccgagtcccttttgaccatggaataccatcagcctgaggatccagcccctggtaaggccgggactgcagaagcagtcatccctgaaaaccatgaggttctggcaggcccagatgagcaccctcaggacacagatgcaagagatgctgatggggaggctagagaacgggagccagcagaccaagctttgctgcctagccagtgtggggacaaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaaagcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccacccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggcacggtggctcactcctcccttccccccccaactnccccaacca

SEQ ID NO: 285576 - DNA, 2039 bp, Homo sapiens
gcgctccgtcccttctagaggcaggcagagggaagagaaagggtctgttgtttttctctcctgtttctcgctccctctctgctgatcacaaagctgctgaccgggtcagaaagtcctgatggaaatccaccagcgctgggcaggcccctcctcctccagggagcttgtccttgcctaatttttcttcgtcctgatgagaacaaaaaagagagagagaagaaaagaaaaaccacaaacttcctttgaaaaccagcttgtagtcagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaaggtcactcttttgcatcccaagcctggcttaggcaagtccctgaggttagtaaacaccttcagtgcccctcagccgagtcccttttgaccatggaataccatcagcctgaggatccagcccctggtaaggccgggactgcagaagcagtcatccctgaaaaccatgaggttctggcaggcccagatgagcaccctcaggacacagatgcaagagatgctgatggggaggctagagaacgggagccagcagaccaagctttgctgcctagccagtgtggggacaaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaaagcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctgacgcccaccgggaattccgaatt

SEQ ID NO: 285577 - DNA, 1363 bp, Homo sapiens
gcgctccgtcccttctagaggcaggcagagggaagagaaagggtctgttgtttttctctcctgtttctcgctccctctctgctgatcacaaagctgctgaccgggtcagaaagtcctgatggaaatccaccagcgctgggcaggcccctcctcctccagggagcttgtccttgcctaatttttcttcgtcctgatgagaacaaaaaagagagagagaagaaaagaaaaaccacaaacttcctttgaaaaccagcttgtagtcagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaaggtcactcttttgcatcccaagcctggcttaggcaagtccctgaggttagtaaacaccttcagtgcccctcagccgagtcccttttgaccatggaataccatcagcctgaggatccagcccctggtaaggccgggactgcagaagcagtcatccctgaaaaccatgaggttctggcaggcccagatgagcaccctcaggacacagatgcaagagatgctgatggggaggctagagaacgggagccagcagaccaagctttgctgcctagccagtgtggggacaaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggccacagttatccaagtaggagaggggctctcaaaagctggaggagtggggtctcaagaggagaggggctctcaaa

SEQ ID NO: 285578 - DNA, 776 bp, Homo sapiens
agcggctttctccccgccgcattcccggtgtcgacttactagctgcaagcctctgcctgccttcctgcgcgccgttccccgctagtcgctgctgctggcgcgcactcgccgggtttttcctcccacggcctcgagatggtggtgaatgtggcacggaggagccgggccttccaacccggtgggcccgagctccgaaaggccccctcggcagtgagaggggcgggagcccgcgggggccgcgcccttctctcgcttcggactgcgcaacgctgcgctctgggctgacaggcggataaaacggtcccatcaagactgagaaaaagcacaccagctattggcacagcgtgggcagtggggcctacaggatgactgacttagtctacagagatcccggcgtacttaagcaggtagtaaatgaagactcttaagatgacagaaggtgatttttctggtgatcgaggacttccggggtaatgacagtgatgaaatgcaggggacctggttgcccccaagtttcctggcagtgtgtgatactgaggaggtgagcttgtttctggagctgtgctttaagattcatgttacatgtaaagctgtcctcatttgtgactatggacctatggagttgggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtaaaaaaat

SEQ ID NO: 285579 - DNA, 838 bp, Homo sapiens
agcggctttctccccgccgcattcccggtgtcgacttactagctgcaagcctctgcctgccttcctgcgcgccgttccccgctagtcgctgctgctggcgcgcactcgccgggtttttcctcccacggcctcgagatggtggtgaatgtggcacggaggagccgggccttccaacccggtgggcccgagctccgaaaggccccctcggcagtgagaggggcgggagcccgcgggggccgcgcccttctctcgcttcggactgcgcaacgctgcgctctgggctgacaggcggataaaacggtcccatcaagactgagaaaaagcacaccagctattggcacagcgtgggcagtggggcctacaggatgactgacttagtctacagagatcccggcgtacttaagcaggtagtaaatgaagactcttaagatgacagaaggtgatttttctggtgatcgaggacttccggggtaatgacagtgatgaaatgcaggggacctggtaggtttcttttggagactaactgggggctgcctggtgggacagaacagcatgtttccaagggctgtggctggtcatagccatgggatctccaactgcatgcaagagcaacctggaaagactttgacagcgcaggtcagtacaatacctgcaagctgccactcagctttcctataatgtttcaggaccagggctggaagccttccatgtgtcaacttcaatgtagatgggtttttttttttttttttttttgagacggagtcttgctctgtcacccaggctgctggagtgcagtggcatgatctcggctcatggcaacctctgcctcctgggttca

SEQ ID NO: 285580 - DNA, 420 bp, Homo sapiens
gccacaaatgttcagtggtggctggagctcatgatgcattctttggtgggacgtctctcagcattagggagagttgagagtggggtagaaacaaggggttccatgtagcacacactgtatttagaatgactggtccaggatgaaacctaatttgagtggacatccatggatgagaaatgcggatatgggactgagaccagctcctaggaaaatgtctgggtgggggaaatctgggaattagtaacacaatggcttacacttcctttgcaggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtaaaaaaat

SEQ ID NO: 285581 - DNA, 278 bp, Homo sapiens
aggctggagtgcagtggcacaatcttggctaattgcctcccaggttcaagtgattctcctgcctcagcctcctgagtagctgggactataagcacgcaccactatgtctggttacacttcctttgcaggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtaaaaaaat

SEQ ID NO: 285582 - DNA, 1100 bp, Homo sapiens
agcggctttctccccgccgcattcccggtgtcgacttactagctgcaagcctctgcctgccttcctgcgcgccgttccccgctagtcgctgctgctggcgcgcactcgccgggtttttcctcccacggcctcgagatggtggtgaatgtggcacggaggagccgggccttccaacccggtgggcccgagctccgaaaggccccctcggcagtgagaggggcgggagcccgcgggggccgcgcccttctctcgcttcggactgcgcaacgctgcgctctgggctgacaggcggataaaacggtcccatcaagactgagaaaaagcacaccagctattggcacagcgtgggcagtggggcctacaggatgactgacttagtctacagagatcccggcgtacttaagcaggtagtaaatgaagactcttaagatgacagaaggtgatttttctggtgatcgaggacttccggggtaatgacagtgatgaaatgcaggggacctggttgcccccaagtttcctggcagtgtgtgatactgaggaggtgagcttgtttctggagctgtgctttaaggtaaagttgatcagcttaatcctcctgatccctttcccatcggatctgaacactggtcttggtggtcgtaaaaggaggaaaagtaatagtgaagctggcctaaatgttgtaatctggtatatggcatgtgggctagtttcagacaggtttcagagatggttggatctctgaaattgtaaaatgaagtataatcttaggctaagggaaggatgcgtgtgaagctctggaggttggtatagtaatagctgacctattactgcatttgggagggatctgtcatagcttccttgcctcttaattaagggtggtgtttttttcttttagattcatgttacatgtaaagctgtcctcatttgtgactatggacctatggagttgggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtaaaaaaat

SEQ ID NO: 285583 - DNA, 803 bp, Homo sapiens
ttacaggtgcccaccatcacacccagctaattttcttgtatttttagtagagatggttttcaccatgttggctagatgggtctcgaacttctgacctcgggtgatccgcccgactcggcctccccttccaaagtgctgggattacaggcatgagccaccgctcctggccagtttagttttcacgctaagctttttgttctgcaggttgcccccaagtttcctggcagtgtgtgatactgaggaggtgagcttgtttctggagctgtgctttaaggtaaagttgatcagcttaatcctcctgatccctttcccatcggatctgaacactggtcttggtggtcgtaaaaggaggaaaagtaatagtgaagctggcctaaatgttgtaatctggtatatggcatgtgggctagtttcagacaggtttcagagatggttggatctctgaaattgtaaaatgaagtataatcttaggctaagggaaggatgcgtgtgaagctctggaggttggtatagtaatagctgacctattactgcatttgggagggatctgtcatagcttccttgcctcttaattaagggtggtgtttttttcttttagattcatgttacatgtaaagctgtcctcatttgtgactatggacctatggagttgggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtaaaaaaat

SEQ ID NO: 285584 - DNA, 1296 bp, Homo sapiens
agcggctttctccccgccgcattcccggtgtcgacttactagctgcaagcctctgcctgccttcctgcgcgccgttccccgctagtcgctgctgctggcgcgcactcgccgggtttttcctcccacggcctcgagatggtggtgaatgtggcacggaggagccgggccttccaacccggtgggcccgagctccgaaaggccccctcggcagtgagaggggcgggagcccgcgggggccgcgcccttctctcgcttcggactgcgcaacgctgcgctctgggctgacaggcggataaaacggtcccatcaagactgagaaaaagcacaccagctattggcacagcgtgggcagtggggcctacaggatgactgacttagtctacagagatcccggcgtacttaagcaggtagtaatgatggacaggtgaggctttaggcggccgccctgggatctgaattgccccttggcccttatcgaagctgcagctgcttccgcatagctgctgtggtcaaaaaggagcccagagtgacagttttccttgacggtcgccgttctgtttgttgtaactgatctgcaacattttgggaaaatacagttccattgtacctgccacctttcagctgtagccagagacctttatcaaaatgggcttgtttccacagaacagcagaacggttgggggtttgcatgtacagttaaccagcataagactcgtactgggaaaatccagctgggatgtgacacagcttaactgatagcttaaggcatcagtattgggaccaaaggctggtcagatttgtatcattctgaggaccaaatgatgggaacaataaaattgttcatgacagttgttctcattttgctgtccagaatgaagactcttaagatgacagaaggtgatttttctggtgatcgaggacttccggggtaatgacagtgatgaaatgcaggggacctggtaggtttcttttggagactaactgggggctgcctggtgggacagaacagcatgtttccaagggctgtggctggtcatagccatgggatctccaactgcatgcaagagcaacctggaaagactttgacagcgcaggtcagtacaatacctgcaagctgccactcagctttcctataatgtttcaggaccagggctggaagccttccatgtgtcaacttcaatgtagatgggtttttttttttttttttttttgagacggagtcttgctctgtcacccaggctgctggagtgcagtggcatgatctcggctcatggcaacctctgcctcctgggttca

SEQ ID NO: 285585 - DNA, 1017 bp, Homo sapiens
agcggctttctccccgccgcattcccggtgtcgacttactagctgcaagcctctgcctgccttcctgcgcgccgttccccgctagtcgctgctgctggcgcgcactcgccgggtttttcctcccacggcctcgagatggtggtgaatgtggcacggaggagccgggccttccaacccggtgggcccgagctccgaaaggccccctcggcagtgagaggggcgggagcccgcgggggccgcgcccttctctcgcttcggactgcgcaacgctgcgctctgggctgacaggtgagtgttgcaggcaggcggccgggtttacggaaggggtgggggtttgggaaccggtctcctgggggatgcggggatgaatccctgggcctgaagtgtcttaattcagggggaggccgcatgctggtgtcaggatggcctccagttgaatctgtgacatttaccagctaggtgattttgggactggtgactacgcgcgagacctctggaggtcgccctggtagacacggttttcagaaggacgggttttaggcattcagacccttgcgtgcatcccagcttgttgctttcagcctcgctaagtgactaagcgaccttcaggaagtaacttaatcggtctaaacctcttacctgtaataggcggataaaacggtcccatcaagactgagaaaaagcacaccagctattggcacagcgtgggcagtggggcctacaggatgactgacttagtctacagagatcccggcgtacttaagcaggtagtaaatgaagactcttaagatgacagaaggtgatttttctggtgatcgaggacttccggggtaatgacagtgatgaaatgcaggggacctggttgcccccaagtttcctggcagtgtgtgatactgaggaggtgagcttgtttctggagctgtgctttaagattcatgttacatgtaaagctgtcctcatttgtgactatggacctatggagttgggacctctctatagatacctagtagaggctcc

SEQ ID NO: 285586 - DNA, 1194 bp, Homo sapiens
agcggctttctccccgccgcattcccggtgtcgacttactagctgcaagcctctgcctgccttcctgcgcgccgttccccgctagtcgctgctgctggcgcgcactcgccgggtttttcctcccacggcctcgagatggtggtgaatgtggcacggaggagccgggccttccaacccggtgggcccgagctccgaaaggccccctcggcagtgagaggggcgggagcccgcgggggccgcgcccttctctcgcttcggactgcgcaacgctgcgctctgggctgacaggcggataaaacggtcccatcaagactgagaaaaagcacaccagctattggcacagcgtgggcagtggggcctacaggatgactgacttagtctacagagatcccggcgtacttaagcaggtagtaatgatggacaggtgaggctttaggcggccgccctgggatctgaattgccccttggcccttatcgaagctgcagctgcttccgcatagctgctgtggtcaaaaaggagcccagagtgacagttttccttgacggtcgccgttctgtttgttgtaactgatctgcaacattttgggaaaatacagttccattgtacctgccacctttcagctgtagccagagacctttatcaaaatgggcttgtttccacagaacagcagaacggttgggggtttgcatgtacagttaaccagcataagactcgtactgggaaaatccagctgggatgtgacacagcttaactgatagcttaaggcatcagtattgggaccaaaggctggtcagatttgtatcattctgaggaccaaatgatgggaacaatatgaagactcttaagatgacagaaggtgatttttctggtgatcgaggacttccggggtaatgacagtgatgaaatgcaggggacctggttgcccccaagtttcctggcagtgtgtgatactgaggaggtgagcttgtttctggagctgtgctttaagattcatgttacatgtaaagctgtcctcatttgtgactatggacctatggagttgggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtaaaaaaat

SEQ ID NO: 285587 - DNA, 449 bp, Homo sapiens
ttacaggtgcccaccatcacacccagctaattttcttgtatttttagtagagatggttttcaccatgttggctagatgggtctcgaacttctgacctcgggtgatccgcccgactcggcctccccttccaaagtgctgggattacaggcatgagccaccgctcctggccagtttagttttcacgctaagctttttgttctgcaggttgcccccaagtttcctggcagtgtgtgatactgaggagattcatgttacatgtaaagctgtcctcatttgtgactatggacctatggagttgggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtaaaaaaat

SEQ ID NO: 285588 - DNA, 746 bp, Homo sapiens
agcggctttctccccgccgcattcccggtgtcgacttactagctgcaagcctctgcctgccttcctgcgcgccgttccccgctagtcgctgctgctggcgcgcactcgccgggtttttcctcccacggcctcgagatggtggtgaatgtggcacggaggagccgggccttccaacccggtgggcccgagctccgaaaggccccctcggcagtgagaggggcgggagcccgcgggggccgcgcccttctctcgcttcggactgcgcaacgctgcgctctgggctgacaggcggataaaacggtcccatcaagactgagaaaaagcacaccagctattggcacagcgtgggcagtggggcctacaggatgactgacttagtctacagagatcccggcgtacttaagcaggtagtaaatgaagactcttaagatgacagaaggtgatttttctggtgatcgaggacttccggggtaatgacagtgatgaaatgcaggggacctggttgcccccaagtttcctggcagtgtgtgatactgaggagattcatgttacatgtaaagctgtcctcatttgtgactatggacctatggagttgggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtaaaaaaat

SEQ ID NO: 285589 - DNA, 1558 bp, Homo sapiens
agcggctttctccccgccgcattcccggtgtcgacttactagctgcaagcctctgcctgccttcctgcgcgccgttccccgctagtcgctgctgctggcgcgcactcgccgggtttttcctcccacggcctcgagatggtggtgaatgtggcacggaggagccgggccttccaacccggtgggcccgagctccgaaaggccccctcggcagtgagaggggcgggagcccgcgggggccgcgcccttctctcgcttcggactgcgcaacgctgcgctctgggctgacaggcggataaaacggtcccatcaagactgagaaaaagcacaccagctattggcacagcgtgggcagtggggcctacaggatgactgacttagtctacagagatcccggcgtacttaagcaggtagtaatgatggacaggtgaggctttaggcggccgccctgggatctgaattgccccttggcccttatcgaagctgcagctgcttccgcatagctgctgtggtcaaaaaggagcccagagtgacagttttccttgacggtcgccgttctgtttgttgtaactgatctgcaacattttgggaaaatacagttccattgtacctgccacctttcagctgtagccagagacctttatcaaaatgggcttgtttccacagaacagcagaacggttgggggtttgcatgtacagttaaccagcataagactcgtactgggaaaatccagctgggatgtgacacagcttaactgatagcttaaggcatcagtattgggaccaaaggctggtcagatttgtatcattctgaggaccaaatgatgggaacaataaaattgttcatgacagttgttctcattttgctgtccagaatgaagactcttaagatgacagaaggtgatttttctggtgatcgaggacttccggggtaatgacagtgatgaaatgcaggggacctggttgcccccaagtttcctggcagtgtgtgatactgaggaggtgagcttgtttctggagctgtgctttaaggtaaagttgatcagcttaatcctcctgatccctttcccatcggatctgaacactggtcttggtggtcgtaaaaggaggaaaagtaatagtgaagctggcctaaatgttgtaatctggtatatggcatgtgggctagtttcagacaggtttcagagatggttggatctctgaaattgtaaaatgaagtataatcttaggctaagggaaggatgcgtgtgaagctctggaggttggtatagtaatagctgacctattactgcatttgggagggatctgtcatagcttccttgcctcttaattaagggtggtgtttttttcttttagattcatgttacatgtaaagctgtcctcatttgtgactatggacctatggagttgggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtaaaaaaat

SEQ ID NO: 285590 - DNA, 1460 bp, Homo sapiens
agcggctttctccccgccgcattcccggtgtcgacttactagctgcaagcctctgcctgccttcctgcgcgccgttccccgctagtcgctgctgctggcgcgcactcgccgggtttttcctcccacggcctcgagatggtggtgaatgtggcacggaggagccgggccttccaacccggtgggcccgagctccgaaaggccccctcggcagtgagaggggcgggagcccgcgggggccgcgcccttctctcgcttcggactgcgcaacgctgcgctctgggctgacaggtgagtgttgcaggcaggcggccgggtttacggaaggggtgggggtttgggaaccggtctcctgggggatgcggggatgaatccctgggcctgaagtgtcttaattcagggggaggccgcatgctggtgtcaggatggcctccagttgaatctgtgacatttaccagctaggtgattttgggactggtgactacgcgcgagacctctggaggtcgccctggtagacacggttttcagaaggacgggttttaggcattcagacccttgcgtgcatcccagcttgttgctttcagcctcgctaagtgactaagcgaccttcaggaagtaacttaatcggtctaaacctcttacctgtaataggcggataaaacggtcccatcaagactgagaaaaagcacaccagctattggcacagcgtgggcagtggggcctacaggatgactgacttagtctacagagatcccggcgtacttaagcaggtagtaaatgaagactcttaagatgacagaaggtgatttttctggtgatcgaggacttccggggtaatgacagtgatgaaatgcaggggacctggttgcccccaagtttcctggcagtgtgtgatactgaggaggtgagcttgtttctggagctgtgctttaaggtaaagttgatcagcttaatcctcctgatccctttcccatcggatctgaacactggtcttggtggtcgtaaaaggaggaaaagtaatagtgaagctggcctaaatgttgtaatctggtatatggcatgtgggctagtttcagacaggtttcagagatggttggatctctgaaattgtaaaatgaagtataatcttaggctaagggaaggatgcgtgtgaagctctggaggttggtatagtaatagctgacctattactgcatttgggagggatctgtcatagcttccttgcctcttaattaagggtggtgtttttttcttttagattcatgttacatgtaaagctgtcctcatttgtgactatggacctatggagttgggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtaaaaaaat

SEQ ID NO: 285591 - DNA, 1204 bp, Homo sapiens
agcggctttctccccgccgcattcccggtgtcgacttactagctgcaagcctctgcctgccttcctgcgcgccgttccccgctagtcgctgctgctggcgcgcactcgccgggtttttcctcccacggcctcgagatggtggtgaatgtggcacggaggagccgggccttccaacccggtgggcccgagctccgaaaggccccctcggcagtgagaggggcgggagcccgcgggggccgcgcccttctctcgcttcggactgcgcaacgctgcgctctgggctgacaggcggataaaacggtcccatcaagactgagaaaaagcacaccagctattggcacagcgtgggcagtggggcctacaggatgactgacttagtctacagagatcccggcgtacttaagcaggtagtaatgatggacaggtgaggctttaggcggccgccctgggatctgaattgccccttggcccttatcgaagctgcagctgcttccgcatagctgctgtggtcaaaaaggagcccagagtgacagttttccttgacggtcgccgttctgtttgttgtaactgatctgcaacattttgggaaaatacagttccattgtacctgccacctttcagctgtagccagagacctttatcaaaatgggcttgtttccacagaacagcagaacggttgggggtttgcatgtacagttaaccagcataagactcgtactgggaaaatccagctgggatgtgacacagcttaactgatagcttaaggcatcagtattgggaccaaaggctggtcagatttgtatcattctgaggaccaaatgatgggaacaataaaattgttcatgacagttgttctcattttgctgtccagaatgaagactcttaagatgacagaaggtgatttttctggtgatcgaggacttccggggtaatgacagtgatgaaatgcaggggacctggttgcccccaagtttcctggcagtgtgtgatactgaggagattcatgttacatgtaaagctgtcctcatttgtgactatggacctatggagttgggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtaaaaaaat

SEQ ID NO: 285592 - DNA, 908 bp, Homo sapiens
cttcctggagacctgagctcctgttctccatggtgatccattcagtgacttctccaaactatctggtaacagtattggctcagaccacggaactgccctttgataccaattgcaagttctctgacccactgtggatccatgctcagtctgcatacaacactcaggacagatcatcgagagagaaggaatctacattccctcgccaaatgcaacactagaagtgaacacagacttggaagttggcaacgtgcttgagaaatgctagggtgacttatctgggctgcaggcaagggagcaaagtgacccatggggccaatcaccaacacaggatccaccaagtattgaatgaccattcttggtcatcgctattcagagaggcagaagtaatttttactggaaagcccacaagcatgacttttccatcccttcagtttgcaagttcgtgcagatgataggagaaaaaatagcccagcacatttgcatttaagtcttgaaatctaaatatttccatgagtcattcattattcccgtataactcagtgtttgcatgcaaataactttaatgacataaatgcttataaaataagtctcttaccatatgaacgcggtaaagaatgctaattcccagagtcatgaatggcttagagaaatcaatcaccttctcccgttcagctgtaatggtgaggcctgccacagccagatctgctttctgaaaagaacagagacagcccgtcagtggggtggccataggagaagaggcacagagacttgcgaccagcaaccgtcactgctattggagatgtgatgctggtctggcttcttgcttgaggagtggctctaagtcaacactgcatacagatctgaatgatcactcataaaagtacatggatattgaagctataaaaaaa

SEQ ID NO: 285593 - DNA, 2135 bp, Homo sapiens
aagcacatgaggagaagccttagcaacctcaataccgaagttcttcgcgcgctcgctctttctgcctccgcccgaactatgcctgagtccctcacaggagttggatagtagaggcgagagaaggaagtctttgcaggccaaaattgggacaacctgcttggacttccgcctcccggcctccggaaggcagtgcgcacgcgctcgctgcgactccggcgcggttgacttccgctcccactgtgctctgcgagccgaatcatggatcacactgacaatgagttacaaggcactaatagttctggatccttgggtggtcttgatgttcgcagacgaattcctataaagctcatctccaaacaagcaaacaaagcgaaacctgcaccgcgaactcaaagaactataaacaggatgcctgcaaaggctccacctggtgatgaagaaggatttgattataatgaagaagaacggtatgactgtaaagggggtgagctgtttgcaaatcagcgaagatttcctggacaccttttttgggactttcagataaacatcttaggtgaaaaggatgatacaccagttcatttctgtgacaagtgtggattgcctattaaaatctatgggagaatgattccatgcaagcatgttttttgctatgactgtgctattttacatgaaaaaaagggagataagatgtgtccaggctgtagtgatcctgtgcagcgaattgagcagtgtacacgaggttctctcttcatgtgtagcattgttcaagggtgcaagagaacatatttgtctcagagagacttacaggctcatatcaaccatcgccatatgagagctggaaaacctgttacccgtgcttcacttgaaaatgttcatcctcctattgccccaccaccaactgaaatccctgagcgttttataatgccaccagacaagcaccatatgagccatattccgccaaagcagcacatcatgatgccaccacctcctttgcaacatgtgccacatgagcactataatcagccacatgaggatattcgtgctcctccagcagaattgtccatggctccacctccacctcgatcggtcagtcaggaaacctttcgtatttcaacaagaaaacacagcaatttaataaccgtccctattcaggatgactcaaattcaggtgctagagaaccaccacctcctgccccagcacctgctcaccatcatcctgaatatcagggtcaaccagtggtatcgcaccctcatcatattatgcctccacagcaacattatgcaccacccccacctcctccaccaccaataagccatccaatgccacatcctccccaggctgcaggtactcctcacttggtatatagccaagctccacctccaccaatgacctctgctccaccaccaataacccctccccctggacatattattgcccagatgccaccttatatgaatcatcctcctccaggacctcccccacctcaacatggtggtccacctgtaactgcaccccctcctcaccattataatcctaactcattaccccagttcactgaagatcaaggaactctgagccctccatttacacaaccagggggaatgagtcctggtatatggcctgcaccaagagggccaccaccacctccacgattgcagggtccgccttctcaaaccccacttcctggaccacatcatccagatcagacaagatatagaccgtattaccaatgataatagtattttgaatggaagatatgagggggaaaaaaacttatgtgtagtcaatcttttaagctttgactgttttgggaaggaagagtacctcttatcgaggtagtataaaacacatagggtcttgtttcttaaaatggttttaaatcttgaccttaagattgatttcaagtaccatactgtagtacagataagtggctcagttgagcacagctatattttaacatctctttgttcccctagtttagtaaattgacccagaggtgaccatttgtaaaaaatttgaaaaaatttttcattgttttacttcagaagtattgttttgttaaacccaacgtttagtttttcttgtgatacattttgttaacctgtgtaaaaggattaaatttcaatatggttgt

SEQ ID NO: 285594 - DNA, 571 bp, Homo sapiens
ttcgactcacagatcttgggagtagtccaataacttcatcaatttattaaaggattctgtatctcaaaaggggttaaaaagcattgccttaagtgttgatccaaaataaataaaattagcagttaaacttaatgtaatattgaaaatcagaacccagatctttaaccttgataatgttaggtatggtgttttaatacctgtggcagaataatctttaaaaagaaaaactaaaagaaattacaacttttttttcctaacacagacaatgagttacaaggcactaatagttctggatccttgggtggtcttgatgttcgcagacgaattcctataaagctcatctccaaacaagcaaacaaagcgaaacctgcaccgcgaactcaaagaactataaacaggatgcctgcaaaggctccacctggtgatgaaggtaatttgtttaactaataggtccaacactctttctgttttatctgattgcttcggacagtctgtgtgatcttatagctacctctttttgtcttacatattctattcattcttcaaccttcttgtttgacttctcattgta

SEQ ID NO: 285595 - DNA, 4230 bp, Homo sapiens
aagcacatgaggagaagccttagcaacctcaataccgaagttcttcgcgcgctcgctctttctgcctccgcccgaactatgcctgagtccctcacaggagttggatagtagaggcgagagaaggaagtctttgcaggccaaaattgggacaacctgcttggacttccgcctcccggcctccggaaggcagtgcgcacgcgctcgctgcgactccggcgcggttgacttccgctcccactgtgctctgcgagccgaatcatggatcacactgacaatgagttacaaggcactaatagttctggatccttgggtggtcttgatgttcgcagacgaattcctataaagctcatctccaaacaagcaaacaaagcgaaacctgcaccgcgaactcaaagaactataaacaggatgcctgcaaaggctccacctggtgatgaagaaggatttgattataatgaagaagaacggtatgactgtaaagggggtgagctgtttgcaaatcagcgaagatttcctggacaccttttttgggactttcagataaacatcttaggtgaaaaggatgatacaccagttcatttctgtgacaagtgtggattgcctattaaaatctatgggagaatgattccatgcaagcatgttttttgctatgactgtgctattttacatgaaaaaaagggagataagatgtgtccaggctgtagtgatcctgtgcagcgaattgagcagtgtacacgaggttctctcttcatgtgtagcattgttcaagggtgcaagagaacatatttgtctcagagagacttacaggctcatatcaaccatcgccatatgagagctggaaaacctgttacccgtgcttcacttgaaaatgttcatcctcctattgccccaccaccaactgaaatccctgagcgttttataatgccaccagacaagcaccatatgagccatattccgccaaagcagcacatcatgatgccaccacctcctttgcaacatgtgccacatgagcactataatcagccacatgaggatattcgtgctcctccagcagaattgtccatggctccacctccacctcgatcggtcagtcaggaaacctttcgtatttcaacaagaaaacacagcaatttaataaccgtccctattcaggatgactcaaattcaggtgctagagaaccaccacctcctgccccagcacctgctcaccatcatcctgaatatcagggtcaaccagtggtatcgcaccctcatcatattatgcctccacagcaacattatgcaccacccccacctcctccaccaccaataagccatccaatgccacatcctccccaggctgcaggtactcctcacttggtatatagccaagctccacctccaccaatgacctctgctccaccaccaataacccctccccctggacatattattgcccagatgccaccttatatgaatcatcctcctccaggacctcccccacctcaacatggtggtccacctgtaactgcaccccctcctcaccattataatcctaactcattaccccagttcactgaagatcaaggaactctgagccctccatttacacaaccagggggaatgagtcctggtatatggcctgcaccaagagggccaccaccacctccacgattgcagggtccgccttctcaaaccccacttcctggaccacatcatccagatcagacaagatatagaccgtattaccaatgataatagtattttgaatggaagatatgagggggaaaaaaacttatgtgtagtcaatcttttaagctttgactgttttgggaaggaagagtacctcttatcgaggtagtataaaacacatagggtcttgtttcttaaaatggttttaaatcttgaccttaagattgatttcaagtaccatactgtagtacagataagtggctcagttgagcacagctatattttaacatctctttgttcccctagtttagtaaattgacccagaggtgaccatttgtaaaaaatttgaaaaaatttttcattgttttacttcagaagtattgttttgttaaacccaacgtttagtttttcttgtgatacattttgttaacctgtgtaaaaggattaaatttcaatatggttgtaaaaatgctatttttatgtgaatttaagtgcagccacatactgttttttaaaccatatgttttaccactaatttcccaaagttataataaaatcctgaaagtaaaaatctactagaatttgctgtaaggcagactgttaaatgatagagaattatttcacattttaggcactgaaatgttgaggtttcgaggtatagtaagtatacaatgcacttcacttggatgccttttcatttttaggcagcctcaggagcaccaaaatacattggaattctagtactaagatatatttgttcgtaatgttaaaagacattactaattatttggaaagagatggccaaaataatcaactctacaggcttcaagctggtgggggaatgctgttactcattaatgcttttttactgaatggtcggaatcacatatgcaccacacatactgatcttaagtaacattattttatagaactgtttaaatgggtttaaatggtgttctttagatgaaatgtgttctgtttgttcattgtcttaaactgaatagggctgaataggctttatgtaattcttcatttcatggtagagtttgatgctgtgtttaagtgggttcttgtttataggattttcaactacagtttgaatgccatggaggaatttgaataatatattaatgaaggacatattcttgtaatcacaaatttgcatttgctcaggtttcattgctgtgtgataggatttttcctctaacttgaaatttaaaaacttttatttcctattccttttgtcggtaaagcagtctgaatttggaacattttatcatggagtcaacagtgaagactaccagataattttgtattggagaagaggaaataacagctaaattgtggatttcagtgctttacatggtgcctttcgagtcagcttttacattataggggcttgttatagtttagctaagatgaccacttaacagtttatacagaactcatatgtataaatcaacattcttaggatattatttatatcctttgaataaatccctgtgaagtttttcctccccactaaaatggtgcataataaaacatgaaatatgtagtatgcagatatcatttattagatagtttgtagtgtatacatttagaacatacttcttttgacaaagggtgatctgattgctaatttaccattttattctgtcaggtacaggtgaaacaaattctcatcttgaatgatcagatgcaaaatcatttctgaaccctagagcagaagttagaaataacaaaatggccgtttcaaccttgactggccaaaaataactaataaacttttttgttttaagtcaggcaagtgattttctacatttagcagtttgaaagtccagtgttaatgcaatatttctagtgagaaatgcttgttattaaaagcatgggagtgatagtgtgaaatggtggtgagtgcttctatcatattactgtaggtacttggactggtgcaaacttgattccttttcatccccctgtttaggagctattaaaatattactgttaaaaatccaaaccattctttgttccatgtaataagaaaatagccaaaatcactttagagcttctcaactatttatgaagagctatcctgcttttattgaaagtcactagagttgaatgtggtaagaaaccacttagcctatgtattggacgagaaaatcagtatcatgataaaattttgaattaagagaacccttgtagagtttttaaaaaatgatttattttcaattaggtttaagaaatctatgttatgcagggaggcatatcagatgaatgttgtagcagacaaaagttttaaatcgtgttagacttgaattcatcaattgtttgaatgagggtgggtgggtagaaggataacaaaattactgttagtgtttctttccttacggaaaaagatgtgaatcccagccttatttcagggaagcctttgaagctatgatggacataagtctaaattaaatgtatgtatgtttcattatattgctcttaagactactgaggtggcagtttaattcttaaaaacaataaaatggaagcataaatactaaaaaacta

SEQ ID NO: 285596 - DNA, 3871 bp, Homo sapiens
ttaccagttctagggccaaaagagtcgtgagaagcctggctccttggagggatatatttgtctgctcagctttactttagaaggatttgattataatgaagaagaacggtatgactgtaaagggggtgagctgtttgcaaatcagcgaagatttcctggacaccttttttgggactttcagataaacatcttaggtgaaaaggatgatacaccagttcatttctgtgacaagtgtggattgcctattaaaatctatgggagaatgattccatgcaagcatgttttttgctatgactgtgctattttacatgaaaaaaagggagataagatgtgtccaggctgtagtgatcctgtgcagcgaattgagcagtgtacacgaggttctctcttcatgtgtagcattgttcaagggtgcaagagaacatatttgtctcagagagacttacaggctcatatcaaccatcgccatatgagagctggaaaacctgttacccgtgcttcacttgaaaatgttcatcctcctattgccccaccaccaactgaaatccctgagcgttttataatgccaccagacaagcaccatatgagccatattccgccaaagcagcacatcatgatgccaccacctcctttgcaacatgtgccacatgagcactataatcagccacatgaggatattcgtgctcctccagcagaattgtccatggctccacctccacctcgatcggtcagtcaggaaacctttcgtatttcaacaagaaaacacagcaatttaataaccgtccctattcaggatgactcaaattcaggtgctagagaaccaccacctcctgccccagcacctgctcaccatcatcctgaatatcagggtcaaccagtggtatcgcaccctcatcatattatgcctccacagcaacattatgcaccacccccacctcctccaccaccaataagccatccaatgccacatcctccccaggctgcaggtactcctcacttggtatatagccaagctccacctccaccaatgacctctgctccaccaccaataacccctccccctggacatattattgcccagatgccaccttatatgaatcatcctcctccaggacctcccccacctcaacatggtggtccacctgtaactgcaccccctcctcaccattataatcctaactcattaccccagttcactgaagatcaaggaactctgagccctccatttacacaaccagggggaatgagtcctggtatatggcctgcaccaagagggccaccaccacctccacgattgcagggtccgccttctcaaaccccacttcctggaccacatcatccagatcagacaagatatagaccgtattaccaatgataatagtattttgaatggaagatatgagggggaaaaaaacttatgtgtagtcaatcttttaagctttgactgttttgggaaggaagagtacctcttatcgaggtagtataaaacacatagggtcttgtttcttaaaatggttttaaatcttgaccttaagattgatttcaagtaccatactgtagtacagataagtggctcagttgagcacagctatattttaacatctctttgttcccctagtttagtaaattgacccagaggtgaccatttgtaaaaaatttgaaaaaatttttcattgttttacttcagaagtattgttttgttaaacccaacgtttagtttttcttgtgatacattttgttaacctgtgtaaaaggattaaatttcaatatggttgtaaaaatgctatttttatgtgaatttaagtgcagccacatactgttttttaaaccatatgttttaccactaatttcccaaagttataataaaatcctgaaagtaaaaatctactagaatttgctgtaaggcagactgttaaatgatagagaattatttcacattttaggcactgaaatgttgaggtttcgaggtatagtaagtatacaatgcacttcacttggatgccttttcatttttaggcagcctcaggagcaccaaaatacattggaattctagtactaagatatatttgttcgtaatgttaaaagacattactaattatttggaaagagatggccaaaataatcaactctacaggcttcaagctggtgggggaatgctgttactcattaatgcttttttactgaatggtcggaatcacatatgcaccacacatactgatcttaagtaacattattttatagaactgtttaaatgggtttaaatggtgttctttagatgaaatgtgttctgtttgttcattgtcttaaactgaatagggctgaataggctttatgtaattcttcatttcatggtagagtttgatgctgtgtttaagtgggttcttgtttataggattttcaactacagtttgaatgccatggaggaatttgaataatatattaatgaaggacatattcttgtaatcacaaatttgcatttgctcaggtttcattgctgtgtgataggatttttcctctaacttgaaatttaaaaacttttatttcctattccttttgtcggtaaagcagtctgaatttggaacattttatcatggagtcaacagtgaagactaccagataattttgtattggagaagaggaaataacagctaaattgtggatttcagtgctttacatggtgcctttcgagtcagcttttacattataggggcttgttatagtttagctaagatgaccacttaacagtttatacagaactcatatgtataaatcaacattcttaggatattatttatatcctttgaataaatccctgtgaagtttttcctccccactaaaatggtgcataataaaacatgaaatatgtagtatgcagatatcatttattagatagtttgtagtgtatacatttagaacatacttcttttgacaaagggtgatctgattgctaatttaccattttattctgtcaggtacaggtgaaacaaattctcatcttgaatgatcagatgcaaaatcatttctgaaccctagagcagaagttagaaataacaaaatggccgtttcaaccttgactggccaaaaataactaataaacttttttgttttaagtcaggcaagtgattttctacatttagcagtttgaaagtccagtgttaatgcaatatttctagtgagaaatgcttgttattaaaagcatgggagtgatagtgtgaaatggtggtgagtgcttctatcatattactgtaggtacttggactggtgcaaacttgattccttttcatccccctgtttaggagctattaaaatattactgttaaaaatccaaaccattctttgttccatgtaataagaaaatagccaaaatcactttagagcttctcaactatttatgaagagctatcctgcttttattgaaagtcactagagttgaatgtggtaagaaaccacttagcctatgtattggacgagaaaatcagtatcatgataaaattttgaattaagagaacccttgtagagtttttaaaaaatgatttattttcaattaggtttaagaaatctatgttatgcagggaggcatatcagatgaatgttgtagcagacaaaagttttaaatcgtgttagacttgaattcatcaattgtttgaatgagggtgggtgggtagaaggataacaaaattactgttagtgtttctttccttacggaaaaagatgtgaatcccagccttatttcagggaagcctttgaagctatgatggacataagtctaaattaaatgtatgtatgtttcattatattgctcttaagactactgaggtggcagtttaattcttaaaaacaataaaatggaagcataaatactaaaaaacta

SEQ ID NO: 285597 - DNA, 4221 bp, Homo sapiens
ttcgactcacagatcttgggagtagtccaataacttcatcaatttattaaaggattctgtatctcaaaaggggttaaaaagcattgccttaagtgttgatccaaaataaataaaattagcagttaaacttaatgtaatattgaaaatcagaacccagatctttaaccttgataatgttaggtatggtgttttaatacctgtggcagaataatctttaaaaagaaaaactaaaagaaattacaacttttttttcctaacacagacaatgagttacaaggcactaatagttctggatccttgggtggtcttgatgttcgcagacgaattcctataaagctcatctccaaacaagcaaacaaagcgaaacctgcaccgcgaactcaaagaactataaacaggatgcctgcaaaggctccacctggtgatgaagaaggatttgattataatgaagaagaacggtatgactgtaaagggggtgagctgtttgcaaatcagcgaagatttcctggacaccttttttgggactttcagataaacatcttaggtgaaaaggatgatacaccagttcatttctgtgacaagtgtggattgcctattaaaatctatgggagaatgattccatgcaagcatgttttttgctatgactgtgctattttacatgaaaaaaagggagataagatgtgtccaggctgtagtgatcctgtgcagcgaattgagcagtgtacacgaggttctctcttcatgtgtagcattgttcaagggtgcaagagaacatatttgtctcagagagacttacaggctcatatcaaccatcgccatatgagagctggaaaacctgttacccgtgcttcacttgaaaatgttcatcctcctattgccccaccaccaactgaaatccctgagcgttttataatgccaccagacaagcaccatatgagccatattccgccaaagcagcacatcatgatgccaccacctcctttgcaacatgtgccacatgagcactataatcagccacatgaggatattcgtgctcctccagcagaattgtccatggctccacctccacctcgatcggtcagtcaggaaacctttcgtatttcaacaagaaaacacagcaatttaataaccgtccctattcaggatgactcaaattcaggtgctagagaaccaccacctcctgccccagcacctgctcaccatcatcctgaatatcagggtcaaccagtggtatcgcaccctcatcatattatgcctccacagcaacattatgcaccacccccacctcctccaccaccaataagccatccaatgccacatcctccccaggctgcaggtactcctcacttggtatatagccaagctccacctccaccaatgacctctgctccaccaccaataacccctccccctggacatattattgcccagatgccaccttatatgaatcatcctcctccaggacctcccccacctcaacatggtggtccacctgtaactgcaccccctcctcaccattataatcctaactcattaccccagttcactgaagatcaaggaactctgagccctccatttacacaaccagggggaatgagtcctggtatatggcctgcaccaagagggccaccaccacctccacgattgcagggtccgccttctcaaaccccacttcctggaccacatcatccagatcagacaagatatagaccgtattaccaatgataatagtattttgaatggaagatatgagggggaaaaaaacttatgtgtagtcaatcttttaagctttgactgttttgggaaggaagagtacctcttatcgaggtagtataaaacacatagggtcttgtttcttaaaatggttttaaatcttgaccttaagattgatttcaagtaccatactgtagtacagataagtggctcagttgagcacagctatattttaacatctctttgttcccctagtttagtaaattgacccagaggtgaccatttgtaaaaaatttgaaaaaatttttcattgttttacttcagaagtattgttttgttaaacccaacgtttagtttttcttgtgatacattttgttaacctgtgtaaaaggattaaatttcaatatggttgtaaaaatgctatttttatgtgaatttaagtgcagccacatactgttttttaaaccatatgttttaccactaatttcccaaagttataataaaatcctgaaagtaaaaatctactagaatttgctgtaaggcagactgttaaatgatagagaattatttcacattttaggcactgaaatgttgaggtttcgaggtatagtaagtatacaatgcacttcacttggatgccttttcatttttaggcagcctcaggagcaccaaaatacattggaattctagtactaagatatatttgttcgtaatgttaaaagacattactaattatttggaaagagatggccaaaataatcaactctacaggcttcaagctggtgggggaatgctgttactcattaatgcttttttactgaatggtcggaatcacatatgcaccacacatactgatcttaagtaacattattttatagaactgtttaaatgggtttaaatggtgttctttagatgaaatgtgttctgtttgttcattgtcttaaactgaatagggctgaataggctttatgtaattcttcatttcatggtagagtttgatgctgtgtttaagtgggttcttgtttataggattttcaactacagtttgaatgccatggaggaatttgaataatatattaatgaaggacatattcttgtaatcacaaatttgcatttgctcaggtttcattgctgtgtgataggatttttcctctaacttgaaatttaaaaacttttatttcctattccttttgtcggtaaagcagtctgaatttggaacattttatcatggagtcaacagtgaagactaccagataattttgtattggagaagaggaaataacagctaaattgtggatttcagtgctttacatggtgcctttcgagtcagcttttacattataggggcttgttatagtttagctaagatgaccacttaacagtttatacagaactcatatgtataaatcaacattcttaggatattatttatatcctttgaataaatccctgtgaagtttttcctccccactaaaatggtgcataataaaacatgaaatatgtagtatgcagatatcatttattagatagtttgtagtgtatacatttagaacatacttcttttgacaaagggtgatctgattgctaatttaccattttattctgtcaggtacaggtgaaacaaattctcatcttgaatgatcagatgcaaaatcatttctgaaccctagagcagaagttagaaataacaaaatggccgtttcaaccttgactggccaaaaataactaataaacttttttgttttaagtcaggcaagtgattttctacatttagcagtttgaaagtccagtgttaatgcaatatttctagtgagaaatgcttgttattaaaagcatgggagtgatagtgtgaaatggtggtgagtgcttctatcatattactgtaggtacttggactggtgcaaacttgattccttttcatccccctgtttaggagctattaaaatattactgttaaaaatccaaaccattctttgttccatgtaataagaaaatagccaaaatcactttagagcttctcaactatttatgaagagctatcctgcttttattgaaagtcactagagttgaatgtggtaagaaaccacttagcctatgtattggacgagaaaatcagtatcatgataaaattttgaattaagagaacccttgtagagtttttaaaaaatgatttattttcaattaggtttaagaaatctatgttatgcagggaggcatatcagatgaatgttgtagcagacaaaagttttaaatcgtgttagacttgaattcatcaattgtttgaatgagggtgggtgggtagaaggataacaaaattactgttagtgtttctttccttacggaaaaagatgtgaatcccagccttatttcagggaagcctttgaagctatgatggacataagtctaaattaaatgtatgtatgtttcattatattgctcttaagactactgaggtggcagtttaattcttaaaaacaataaaatggaagcataaatactaaaaaacta

SEQ ID NO: 285598 - DNA, 951 bp, Homo sapiens
tgactcctgttgatccatatagatcgttgaccattggtgttcgagacatagtacaggtcatgatgaaattctcatcttgaatgatcagatgcaaaatcatttctgaaccctagagcagaagttagaaataacaaaatggccgtttcaaccttgactggccaaaaataactaataaacttttttgttttaagtcaggcaagtgattttctacatttagcagtttgaaagtccagtgttaatgcaatatttctagtgagaaatgcttgttattaaaagcatgggagtgatagtgtgaaatggtggtgagtgcttctatcatattactgtaggtacttggactggtgcaaacttgattccttttcatccccctgtttaggagctattaaaatattactgttaaaaatccaaaccattctttgttccatgtaataagaaaatagccaaaatcactttagagcttctcaactatttatgaagagctatcctgcttttattgaaagtcactagagttgaatgtggtaagaaaccacttagcctatgtattggacgagaaaatcagtatcatgataaaattttgaattaagagaacccttgtagagtttttaaaaaatgatttattttcaattaggtttaagaaatctatgttatgcagggaggcatatcagatgaatgttgtagcagacaaaagttttaaatcgtgttagacttgaattcatcaattgtttgaatgagggtgggtgggtagaaggataacaaaattactgttagtgtttctttccttacggaaaaagatgtgaatcccagccttatttcagggaagcctttgaagctatgatggacataagtctaaattaaatgtatgtatgtttcattatattgctcttaagactactgaggtggcagtttaattcttaaaaacaataaaatggaagcataaatactaaaaaacta

SEQ ID NO: 285599 - DNA, 2960 bp, Homo sapiens
aagcacatgaggagaagccttagcaacctcaataccgaagttcttcgcgcgctcgctctttctgcctccgcccgaactatgcctgagtccctcacaggagttggatagtagaggcgagagaaggaagtctttgcaggccaaaattgggacaacctgcttggacttccgcctcccggcctccggaaggcagtgcgcacgcgctcgctgcgactccggcgcggttgacttccgctcccactgtgctctgcgagccgaatcatggatcacactgacaatgagttacaaggcactaatagttctggatccttgggtggtcttgatgttcgcagacgaattcctataaagctcatctccaaacaagcaaacaaagcgaaacctgcaccgcgaactcaaagaactataaacaggatgcctgcaaaggctccacctggtgatgaagaaggatttgattataatgaagaagaacggtatgactgtaaagggggtgagctgtttgcaaatcagcgaagatttcctggacaccttttttgggactttcagataaacatcttaggtgaaaaggatgatacaccagttcatttctgtgacaagtgtggattgcctattaaaatctatgggagaatgattccatgcaagcatgttttttgctatgactgtgctattttacatgaaaaaaagggagataagatgtgtccaggctgtagtgatcctgtgcagcgaattgagcagtgtacacgaggttctctcttcatgtgtagcattgttcaagggtgcaagagaacatatttgtctcagagagacttacaggctcatatcaaccatcgccatatgagagctggaaaacctgttacccgtgcttcacttgaaaatgttcatcctcctattgccccaccaccaactgaaatccctgagcgttttataatgccaccagacaagcaccatatgagccatattccgccaaagcagcacatcatgatgccaccacctcctttgcaacatgtgccacatgagcactataatcagccacatgaggatattcgtgctcctccagcagaattgtccatggctccacctccacctcgatcggtcagtcaggaaacctttcgtatttcaacaagaaaacacagcaatttaataaccgtccctattcaggatgactcaaattcaggtgctagagaaccaccacctcctgccccagcacctgctcaccatcatcctgaatatcagggtcaaccagtggtatcgcaccctcatcatattatgcctccacagcaacattatgcaccacccccacctcctccaccaccaataagccatccaatgccacatcctccccaggctgcaggtactcctcacttggtatatagccaagctccacctccaccaatgacctctgctccaccaccaataacccctccccctggacatattattgcccagatgccaccttatatgaatcatcctcctccaggacctcccccacctcaacatggtggtccacctgtaactgcaccccctcctcaccattataatcctaactcattaccccagttcactgaagatcaaggaactctgagccctccatttacacaaccagggggaatgagtcctggtatatggcctgcaccaagagggccaccaccacctccacgattgcagggtccgccttctcaaaccccacttcctggaccacatcatccagatcagacaagatatagaccgtattaccaatgataatagtattttgaatggaagatatgagggggaaaaaaacttatgtgtagtcaatcttttaagctttgactgttttgggaaggaagagtacctcttatcgaggtagtataaaacacatagggtcttgtttcttaaaatggttttaaatcttgaccttaagattgatttcaagtaccatactgtagtacagataagtggctcagttgagcacagctatattttaacatctctttgttcccctagtttagtaaattgacccagaggtgaccatttgtaaaaaatttgaaaaaatttttcattgttttacttcagaagtattgttttgttaaacccaacgtttagtttttcttgtgatacattttgttaacctgtgtaaaaggattaaatttcaatatggttgtaaaaatgctatttttatgtgaatttaagtgcagccacatactgttttttaaaccatatgttttaccactaatttcccaaagttataataaaatcctgaaagtaaaaatctactagaatttgctgtaaggcagactgttaaatgatagagaattatttcacattttaggcactgaaatgttgaggtttcgaggtatagtaagtatacaatgcacttcacttggatgccttttcatttttaggcagcctcaggagcaccaaaatacattggaattctagtactaagatatatttgttcgtaatgttaaaagacattactaattatttggaaagagatggccaaaataatcaactctacaggcttcaagctggtgggggaatgctgttactcattaatgcttttttactgaatggtcggaatcacatatgcaccacacatactgatcttaagtaacattattttatagaactgtttaaatgggtttaaatggtgttctttagatgaaatgtgttctgtttgttcattgtcttaaactgaatagggctgaataggctttatgtaattcttcatttcatggtagagtttgatgctgtgtttaagtgggttcttgtttataggattttcaactacagtttgaatgccatggaggaatttgaataatcttttatgacgggcttttctgttattcccaaaaaaaaaaaaaaaaaatttgggccccccccgaaatttaaaccctttgggcggccaggaataacggttaacttccaagacggcacaggtggttccacaaccggaccgcgaaccagggtgttgtcatcaaccccgg

SEQ ID NO: 285600 - DNA, 402 bp, Homo sapiens
attccatgcaagcatgttttttgctatgactgtgctattttacatgaaaaaaagggagataagatgtgtccagggtaagataagattatcattaccttttttaaataataaagttttagtgcaatgatttataagttggattaaaggttagggagtgatgtaaatcaggcaggagatgaaacatacagacatggctaatctttttctgtgagcccagcttgtgttaggtttctctttaatatagggcaaggtagccactatcagtcaactcaaattggtcaaaatgaaatctgtttgccattatagaagtattattataaacaaaaaagttactttttttaatgggacattaaagaagtattaagatatattgagagcaaagactccagaattagaattcct

SEQ ID NO: 285601 - DNA, 773 bp, Homo sapiens
tggatatatgctgcatctataccatgtgtattcttggcaaaacaggtaaatggatgtttataaaatctactttcaatttccgatatattaagcactgtgatgagggtactccttcttttgtttgcaggattttccacactattcgagagagagagtaaataaacttgtgtaagttaattgcatcaactacaaataagacctgtataccctgtgtatttccttatttgtgacaaaattgccactgaaataatcaccctgcccaatcacagtcacaacattcagactgctggcaacactaatctgagattttataaccccaagaccactgtcagtaacaggcctcagtagccagagaaagcaaaaaaattaccacttccaagaagaaaaatgtagacaaatgcattgtgttctcccatggggcacagaggagacactaaacaagaggagattggggcagatgacaaagtgctttgcaggtgttgtgaaggagaggtcatgggaagccaggagatccttgtcccatagatgagcagtaggaaaccagtagaggctttcgagagcagtggattgcctgattcttgagctcattaatgagtctcttctaagctacttgaggaatatgaagaataatgaaagataattgcttcgttgaaatgttgcaacatgtataacgtaagagaaaggcttctaagtggtctgtaatttgcaccacaatgacaagtattttttaccttaaatgtacaagatcttataaattctacttagcttagcaa

SEQ ID NO: 285602 - DNA, 951 bp, Homo sapiens
ggtaaattaatctctcaactggttgaacacagctttagagatgtcaacagcctcctatgagtctagagtcaggtggtacaggctcaactggtctaacagctgcaaattttgagagactgctgtgctaatgtttggggctcagatttaaggtataggtatgatttacgtactttgagcagccaagccttcttcagaagaaacctgagcggcatgtgctcctccccacctgcttccccacaacaggaagaactctctgcagaaggtctcctcaccttgttgaggcctgggaatgtgcaaatgtgcaggattttccacactattcgagagagagagtaaataaacttgtgtaagttaattgcatcaactacaaataagacctgtataccctgtgtatttccttatttgtgacaaaattgccactgaaataatcaccctgcccaatcacagtcacaacattcagactgctggcaacactaatctgagattttataaccccaagaccactgtcagtaacaggcctcagtagccagagaaagcaaaaaaattaccacttccaagaagaaaaatgtagacaaatgcattgtgttctcccatggggcacagaggagacactaaacaagaggagattggggcagatgacaaagtgctttgcaggtgttgtgaaggagaggtcatgggaagccaggagatccttgtcccatagatgagcagtaggaaaccagtagaggctttcgagagcagtggattgcctgattcttgagctcattaatgagtctcttctaagctacttgaggaatatgaagaataatgaaagataattgcttcgttgaaatgttgcaacatgtataacgtaagagaaaggcttctaagtggtctgtaatttgcaccacaatgacaagtattttttaccttaaatgtacaagatcttataaattctacttagcttagcaa

SEQ ID NO: 285603 - DNA, 4750 bp, Homo sapiens
  misc_feature (2895)..(2895): n is a, c, g, or t
aacgtgcagaaagggactgtactactcaaaaccaccaaggaagtggcagaggtaagtcaacatctaatcctgccactctgtgtggcaaagaacgctgggagcaaattacttctgctgctctttgaaggctgtgccagcgtcacctggatggtgtaaaggaaacaagagacaggaacagagcccctcatctcacctctgggctaccatacagaaaagcagaattggcaggaactgaaaatgactaggaagaggacatactgggtgcccaactcttctggtggcctcgtgaatcgtggcatcgacataggcgatgacatggtttcaggacttatttataaaacctatactctccaagatggcccctggagtcagcaagagagaaatcctgaggctccagggagggcagctgtcccaccgtgggggaagtatgatgctgccttgagaaccatgattcccttccgtcccaagccgaggtttcctgccccccagcccctggacaatgctggcctgttctcctacctcaccgtgtcatggctcaccccgctcatgatccaaagcttacggagtcgcttagatgagaacaccatccctccactgtcagtccatgatgcctcagacaaaaatgtccaaaggcttcaccgcctttgggaagaagaagtctcaaggcgagggattgaaaaagcttcagtgcttctggtgatgctgaggttccagagaacaaggttgattttcgatgcacttctgggcatctgcttctgcattgccagtgtactcgggccaatattgattataccaaagatcctggaatattcagaagagcagttggggaatgttgtccatggagtgggactctgctttgccctttttctctccgaatgtgtgaagtctctgagtttctcctccagttggatcatcaaccaacgcacagccatcaggttccgagcagctgtttcctcctttgcctttgagaagctcatccaatttaagtctgtaatacacatcacctcaggagaggccatcagcttcttcaccggtgatgtaaactacctgtttgaaggggtgtgctatggacccctagtactgatcacctgcgcatcgctggtcatctgcagcatttcttcctacttcattattggatacactgcatttattgccatcttatgctatctcctggttttcccactggcggtattcatgacaagaatggctgtgaaggctcagcatcacacatctgaggtcagcgaccagcgcatccgtgtgaccagtgaagttctcacttgcattaagctgattaaaatgtacacatgggagaaaccatttgcaaaaatcattgaagacctaagaaggaaggaaaggaaactattggagaagtgcgggcttgtccagagcctgacaagtataaccttgttcatcatccccacagtggccacagcggtctgggttctcatccacacatccttaaagctgaaactcacagcgtcaatggccttcagcatgctggcctccttgaatctccttcggctgtcagtgttctttgtgcctattgcagtcaaaggtctcacgaattccaagtctgcagtgatgaggttcaagaagtttttcctccaggagagccctgttttctatgtccagacattacaagaccccagcaaagctctggtctttgaggaggccaccttgtcatggcaacagacctgtcccgggatcgtcaatggggcactggagctggagaggaacgggcatgcttctgaggggatgaccaggcctagagatgccctcgggccagaggaagaagggaacagcctgggcccagagttgcacaagatcaacctggtggtgtccaaggggatgatgttaggggtctgcggcaacacggggagtggtaagagcagcctgttgtcagccatcctggaggagatgcacttgctcgagggctcggtgggggtgcagggaagcctggcctatgtcccccagcaggcctggatcgtcagcgggaacatcagggagaacatcctcatgggaggcgcatatgacaaggcccgatacctccaggtgctccactgctgctccctgaatcgggacctggaacttctgccctttggagacatgacagagattggagagcggggcctcaacctctctggggggcagaaacagaggatcagcctggcccgcgccgtctattccgaccgtcagatctacctgctggacgaccccctgtctgctgtggacgcccacgtggggaagcacatttttgaggagtgcattaagaagacactcagggggaagacggtcgtcctggtgacccaccagctgcagtacttagaattttgtggccagatcattttgttggaaaatgggaaaatctgtgaaaatggaactcacagtgagttaatgcagaaaaaggggaaatatgcccaacttatccagaagatgcacaaggaagccacttcggacatgttgcaggacacagcaaagatagcagagaagccaaaggtagaaagtcaggctctggccacctccctggaagagtctctcaacggaaatgctgtgccggagcatcagctcacacaggaggaggagatggaagaaggctccttgagttggagggtctaccaccactacatccaggcagctggaggttacatggtctcttgcataattttcttcttcgtggtgctgatcgtcttcttaacgatcttcagcttctggtggctgagctactggttggagcagggctcggggaccaatagcagccgagagagcaatggaaccatggcagacctgggcaacattgcagacaatcctcaactgtccttctaccagctggtgtacgggctcaacgccctgctcctcatctgtgtgggggtctgctcctcagggattttcaccaangtcacgaggaaggcatccacggccctgcacaacaagctcttcaacaaggttttccgctgccccatgagtttctttgacaccatcccaataggccggcttttgaactgcttcgcaggggacttggaacagctggaccagctcttgcccatcttttcagagcagttcctggtcctgtccttaatggtgatcgccgtcctgttgattgtcagtgtgctgtctccatatatcctgttaatgggagccataatcatggttatttgcttcatttattatatgatgttcaagaaggccatcggtgtgttcaagagactggagaactatagccggtctcctttattctcccacatcctcaattctctgcaaggcctgagctccatccatgtctatggaaaaactgaagacttcatcagccagtttaagaggctgactgatgcgcagaataactacctgctgttgtttctatcttccacacgatggatggcattgaggctggagatcatgaccaaccttgtgaccttggctgttgccctgttcgtggcttttggcatttcctccaccccctactcctttaaagtcatggctgtcaacatcgtgctgcagctggcgtccagcttccaggccactgcccggattggcttggagacagaggcacagttcacggctgtagagaggatactgcagtacatgaagatgtgtgtctcggaagctcctttacacatggaaggcacaagttgtccccaggggtggccacagcatggggaaatcatatttcaggattatcacatgaaatacagagacaacacacccaccgtgcttcacggcatcaacctgaccatccgcggccacgaagtggtgggcatcgtgggaaggacgggctctgggaagtcctccttgggcatggctctcttccgcctggtggagcccatggcaggccggattctcattgacggcgtggacatttgcagcatcggcctggaggacttgcggtccaagctctcagtgatccctcaagatccagtgctgctctcaggaaccatcagattcaacctagatccctttgaccgtcacactgaccagcagatctgggatgccttggagaggacattcctgaccaaggccatctcaaagttccccaaaaagctgcatacagatgtggtggaaaacggtggaaacttctctgtgggggagaggcagctgctctgcattgccagggctgtgcttcgcaactccaagatcatccttatcgatgaagccacagcctccattgacatggagacagacaccctgatccagcgcacaatccgtgaagccttccagggctgcaccgtgctcgtcattgcccaccgtgtcaccactgtgctgaactgtgaccacatcctggttatgggcaatgggaaggtggtagaatttgatcggccggaggtactgcggaagaagcctgggtcattgttcgcagccctcatggccacagccacttcttcactgagataaggagatgtggagacttcatggaggctggcagctgagctcagaggttcacacaggtgcagcttcgaggcccacagtctgcgaccttcttgtttggagatgagaacttctcctggaagcaggggtaaatgtagggggggtggggattgctggatggaaaccctggaataggctacttgatggctctcaagaccttagaaccccagaaccatctaagacatgggattcagtgatcatgtggttctccttttaacttacatgctgaataattttataataaggtaaaagcttatagttttctgatctgtgttagaagtgttgcaaatgctgtactgactttgtaaaatataaaactaaggaaaactca

SEQ ID NO: 285604 - DNA, 4591 bp, Homo sapiens
  misc_feature (2)..(9): n is a, c, g, or t
  misc_feature (11)..(11): n is a, c, g, or t
  misc_feature (13)..(13): n is a, c, g, or t
  misc_feature (2736)..(2736): n is a, c, g, or t
annnnnnnntncnggtgtatttgaataaaccaggttggcaaatcatactatagctgaaagaattggcaggaactgaaaatgactaggaagaggacatactgggtgcccaactcttctggtggcctcgtgaatcgtggcatcgacataggcgatgacatggtttcaggacttatttataaaacctatactctccaagatggcccctggagtcagcaagagagaaatcctgaggctccagggagggcagctgtcccaccgtgggggaagtatgatgctgccttgagaaccatgattcccttccgtcccaagccgaggtttcctgccccccagcccctggacaatgctggcctgttctcctacctcaccgtgtcatggctcaccccgctcatgatccaaagcttacggagtcgcttagatgagaacaccatccctccactgtcagtccatgatgcctcagacaaaaatgtccaaaggcttcaccgcctttgggaagaagaagtctcaaggcgagggattgaaaaagcttcagtgcttctggtgatgctgaggttccagagaacaaggttgattttcgatgcacttctgggcatctgcttctgcattgccagtgtactcgggccaatattgattataccaaagatcctggaatattcagaagagcagttggggaatgttgtccatggagtgggactctgctttgccctttttctctccgaatgtgtgaagtctctgagtttctcctccagttggatcatcaaccaacgcacagccatcaggttccgagcagctgtttcctcctttgcctttgagaagctcatccaatttaagtctgtaatacacatcacctcaggagaggccatcagcttcttcaccggtgatgtaaactacctgtttgaaggggtgtgctatggacccctagtactgatcacctgcgcatcgctggtcatctgcagcatttcttcctacttcattattggatacactgcatttattgccatcttatgctatctcctggttttcccactggcggtattcatgacaagaatggctgtgaaggctcagcatcacacatctgaggtcagcgaccagcgcatccgtgtgaccagtgaagttctcacttgcattaagctgattaaaatgtacacatgggagaaaccatttgcaaaaatcattgaagacctaagaaggaaggaaaggaaactattggagaagtgcgggcttgtccagagcctgacaagtataaccttgttcatcatccccacagtggccacagcggtctgggttctcatccacacatccttaaagctgaaactcacagcgtcaatggccttcagcatgctggcctccttgaatctccttcggctgtcagtgttctttgtgcctattgcagtcaaaggtctcacgaattccaagtctgcagtgatgaggttcaagaagtttttcctccaggagagccctgttttctatgtccagacattacaagaccccagcaaagctctggtctttgaggaggccaccttgtcatggcaacagacctgtcccgggatcgtcaatggggcactggagctggagaggaacgggcatgcttctgaggggatgaccaggcctagagatgccctcgggccagaggaagaagggaacagcctgggcccagagttgcacaagatcaacctggtggtgtccaaggggatgatgttaggggtctgcggcaacacggggagtggtaagagcagcctgttgtcagccatcctggaggagatgcacttgctcgagggctcggtgggggtgcagggaagcctggcctatgtcccccagcaggcctggatcgtcagcgggaacatcagggagaacatcctcatgggaggcgcatatgacaaggcccgatacctccaggtgctccactgctgctccctgaatcgggacctggaacttctgccctttggagacatgacagagattggagagcggggcctcaacctctctggggggcagaaacagaggatcagcctggcccgcgccgtctattccgaccgtcagatctacctgctggacgaccccctgtctgctgtggacgcccacgtggggaagcacatttttgaggagtgcattaagaagacactcagggggaagacggtcgtcctggtgacccaccagctgcagtacttagaattttgtggccagatcattttgttggaaaatgggaaaatctgtgaaaatggaactcacagtgagttaatgcagaaaaaggggaaatatgcccaacttatccagaagatgcacaaggaagccacttcggacatgttgcaggacacagcaaagatagcagagaagccaaaggtagaaagtcaggctctggccacctccctggaagagtctctcaacggaaatgctgtgccggagcatcagctcacacaggaggaggagatggaagaaggctccttgagttggagggtctaccaccactacatccaggcagctggaggttacatggtctcttgcataattttcttcttcgtggtgctgatcgtcttcttaacgatcttcagcttctggtggctgagctactggttggagcagggctcggggaccaatagcagccgagagagcaatggaaccatggcagacctgggcaacattgcagacaatcctcaactgtccttctaccagctggtgtacgggctcaacgccctgctcctcatctgtgtgggggtctgctcctcagggattttcaccaangtcacgaggaaggcatccacggccctgcacaacaagctcttcaacaaggttttccgctgccccatgagtttctttgacaccatcccaataggccggcttttgaactgcttcgcaggggacttggaacagctggaccagctcttgcccatcttttcagagcagttcctggtcctgtccttaatggtgatcgccgtcctgttgattgtcagtgtgctgtctccatatatcctgttaatgggagccataatcatggttatttgcttcatttattatatgatgttcaagaaggccatcggtgtgttcaagagactggagaactatagccggtctcctttattctcccacatcctcaattctctgcaaggcctgagctccatccatgtctatggaaaaactgaagacttcatcagccagtttaagaggctgactgatgcgcagaataactacctgctgttgtttctatcttccacacgatggatggcattgaggctggagatcatgaccaaccttgtgaccttggctgttgccctgttcgtggcttttggcatttcctccaccccctactcctttaaagtcatggctgtcaacatcgtgctgcagctggcgtccagcttccaggccactgcccggattggcttggagacagaggcacagttcacggctgtagagaggatactgcagtacatgaagatgtgtgtctcggaagctcctttacacatggaaggcacaagttgtccccaggggtggccacagcatggggaaatcatatttcaggattatcacatgaaatacagagacaacacacccaccgtgcttcacggcatcaacctgaccatccgcggccacgaagtggtgggcatcgtgggaaggacgggctctgggaagtcctccttgggcatggctctcttccgcctggtggagcccatggcaggccggattctcattgacggcgtggacatttgcagcatcggcctggaggacttgcggtccaagctctcagtgatccctcaagatccagtgctgctctcaggaaccatcagattcaacctagatccctttgaccgtcacactgaccagcagatctgggatgccttggagaggacattcctgaccaaggccatctcaaagttccccaaaaagctgcatacagatgtggtggaaaacggtggaaacttctctgtgggggagaggcagctgctctgcattgccagggctgtgcttcgcaactccaagatcatccttatcgatgaagccacagcctccattgacatggagacagacaccctgatccagcgcacaatccgtgaagccttccagggctgcaccgtgctcgtcattgcccaccgtgtcaccactgtgctgaactgtgaccacatcctggttatgggcaatgggaaggtggtagaatttgatcggccggaggtactgcggaagaagcctgggtcattgttcgcagccctcatggccacagccacttcttcactgagataaggagatgtggagacttcatggaggctggcagctgagctcagaggttcacacaggtgcagcttcgaggcccacagtctgcgaccttcttgtttggagatgagaacttctcctggaagcaggggtaaatgtagggggggtggggattgctggatggaaaccctggaataggctacttgatggctctcaagaccttagaaccccagaaccatctaagacatgggattcagtgatcatgtggttctccttttaacttacatgctgaataattttataataaggtaaaagcttatagttttctgatctgtgttagaagtgttgcaaatgctgtactgactttgtaaaatataaaactaaggaaaactca

SEQ ID NO: 285605 - DNA, 254 bp, Homo sapiens
aacgtgcagaaagggactgtactactcaaaaccaccaaggaagtggcagaggtaagtcaacatctaatcctgccactctgtgtggcaaagaacgctgggagcaaattacttctgctgctctttgaaggctgtgccagcgtcacctggatggtgtaaaggaaacaagagacaggaacagagcccctcatctcacctctgggctaccatacagaaaagcaggtaactggggaaggacagacttgtgcgtggaaaca

SEQ ID NO: 285606 - DNA, 4120 bp, Homo sapiens
  misc_feature (2222)..(2222): n is a, c, g, or t
agcggggtactttgatttacagtccagcctagactgcaccaatgggggaggtgggagtcttcccagaagaaaactgaggcactggtaccagctacggggaggtgaagatattgattataccaaagatcctggaatattcagaagagcagttggggaatgttgtccatggagtgggactctgctttgccctttttctctccgaatgtgtgaagtctctgagtttctcctccagttggatcatcaaccaacgcacagccatcaggttccgagcagctgtttcctcctttgcctttgagaagctcatccaatttaagtctgtaatacacatcacctcaggagaggccatcagcttcttcaccggtgatgtaaactacctgtttgaaggggtgtgctatggacccctagtactgatcacctgcgcatcgctggtcatctgcagcatttcttcctacttcattattggatacactgcatttattgccatcttatgctatctcctggttttcccactggcggtattcatgacaagaatggctgtgaaggctcagcatcacacatctgaggtcagcgaccagcgcatccgtgtgaccagtgaagttctcacttgcattaagctgattaaaatgtacacatgggagaaaccatttgcaaaaatcattgaagacctaagaaggaaggaaaggaaactattggagaagtgcgggcttgtccagagcctgacaagtataaccttgttcatcatccccacagtggccacagcggtctgggttctcatccacacatccttaaagctgaaactcacagcgtcaatggccttcagcatgctggcctccttgaatctccttcggctgtcagtgttctttgtgcctattgcagtcaaaggtctcacgaattccaagtctgcagtgatgaggttcaagaagtttttcctccaggagagccctgttttctatgtccagacattacaagaccccagcaaagctctggtctttgaggaggccaccttgtcatggcaacagacctgtcccgggatcgtcaatggggcactggagctggagaggaacgggcatgcttctgaggggatgaccaggcctagagatgccctcgggccagaggaagaagggaacagcctgggcccagagttgcacaagatcaacctggtggtgtccaaggggatgatgttaggggtctgcggcaacacggggagtggtaagagcagcctgttgtcagccatcctggaggagatgcacttgctcgagggctcggtgggggtgcagggaagcctggcctatgtcccccagcaggcctggatcgtcagcgggaacatcagggagaacatcctcatgggaggcgcatatgacaaggcccgatacctccaggtgctccactgctgctccctgaatcgggacctggaacttctgccctttggagacatgacagagattggagagcggggcctcaacctctctggggggcagaaacagaggatcagcctggcccgcgccgtctattccgaccgtcagatctacctgctggacgaccccctgtctgctgtggacgcccacgtggggaagcacatttttgaggagtgcattaagaagacactcagggggaagacggtcgtcctggtgacccaccagctgcagtacttagaattttgtggccagatcattttgttggaaaatgggaaaatctgtgaaaatggaactcacagtgagttaatgcagaaaaaggggaaatatgcccaacttatccagaagatgcacaaggaagccacttcggacatgttgcaggacacagcaaagatagcagagaagccaaaggtagaaagtcaggctctggccacctccctggaagagtctctcaacggaaatgctgtgccggagcatcagctcacacaggaggaggagatggaagaaggctccttgagttggagggtctaccaccactacatccaggcagctggaggttacatggtctcttgcataattttcttcttcgtggtgctgatcgtcttcttaacgatcttcagcttctggtggctgagctactggttggagcagggctcggggaccaatagcagccgagagagcaatggaaccatggcagacctgggcaacattgcagacaatcctcaactgtccttctaccagctggtgtacgggctcaacgccctgctcctcatctgtgtgggggtctgctcctcagggattttcaccaangtcacgaggaaggcatccacggccctgcacaacaagctcttcaacaaggttttccgctgccccatgagtttctttgacaccatcccaataggccggcttttgaactgcttcgcaggggacttggaacagctggaccagctcttgcccatcttttcagagcagttcctggtcctgtccttaatggtgatcgccgtcctgttgattgtcagtgtgctgtctccatatatcctgttaatgggagccataatcatggttatttgcttcatttattatatgatgttcaagaaggccatcggtgtgttcaagagactggagaactatagccggtctcctttattctcccacatcctcaattctctgcaaggcctgagctccatccatgtctatggaaaaactgaagacttcatcagccagtttaagaggctgactgatgcgcagaataactacctgctgttgtttctatcttccacacgatggatggcattgaggctggagatcatgaccaaccttgtgaccttggctgttgccctgttcgtggcttttggcatttcctccaccccctactcctttaaagtcatggctgtcaacatcgtgctgcagctggcgtccagcttccaggccactgcccggattggcttggagacagaggcacagttcacggctgtagagaggatactgcagtacatgaagatgtgtgtctcggaagctcctttacacatggaaggcacaagttgtccccaggggtggccacagcatggggaaatcatatttcaggattatcacatgaaatacagagacaacacacccaccgtgcttcacggcatcaacctgaccatccgcggccacgaagtggtgggcatcgtgggaaggacgggctctgtaggtttttactgagcacctactatgtgcctgggaaccgaaagggaagtcctccttgggcatggctctcttccgcctggtggagcccatggcaggccggattctcattgacggcgtggacatttgcagcatcggcctggaggacttgcggtccaagctctcagtgatccctcaagatccagtgctgctctcaggaaccatcagattcaacctagatccctttgaccgtcacactgaccagcagatctgggatgccttggagaggacattcctgaccaaggccatctcaaagttccccaaaaagctgcatacagatgtggtggaaaacggtggaaacttctctgtgggggagaggcagctgctctgcattgccagggctgtgcttcgcaactccaagatcatccttatcgatgaagccacagcctccattgacatggagacagacaccctgatccagcgcacaatccgtgaagccttccagggctgcaccgtgctcgtcattgcccaccgtgtcaccactgtgctgaactgtgaccacatcctggttatgggcaatgggaaggtggtagaatttgatcggccggaggtactgcggaagaagcctgggtcattgttcgcagccctcatggccacagccacttcttcactgagataaggagatgtggagacttcatggaggctggcagctgagctcagaggttcacacaggtgcagcttcgaggcccacagtctgcgaccttcttgtttggagatgagaacttctcctggaagcaggggtaaatgtagggggggtggggattgctggatggaaaccctggaataggctacttgatggctctcaagaccttagaaccccagaaccatctaagacatgggattcagtgatcatgtggttctccttttaacttacatgctgaataattttataataaggtaaaagcttatagttttctgatctgtgttagaagtgttgcaaatgctgtactgactttgtaaaatataaaactaaggaaaactca

SEQ ID NO: 285607 - DNA, 2430 bp, Homo sapiens
atgacgcccaggatggtgctttgcagcgacgtgcccttcagaaggcggctccgcaccagctgcaggttgcgggccgagtccacgctggtgcgcatggtggagccgggcagcaggacgccctcgtgggtgagcagcagcgggaggcgactggggatctggatggggctcactgatgacatgctggcagcctttcgcactgggggctgtcaaaaagagccagacagacagctgcccccggcctgccccgcagtcaccaaacctcagacccgcctccacgcctccgcttccggctacgcgctacggtccgtccccgggcccaaaagccatggcttcgcgctgctctctaggagagcctcccgaattggcaggaactgaaaatgactaggaagaggacatactgggtgcccaactcttctggtggcctcgtgaatcgtggcatcgacataggcgatgacatggtttcaggacttatttataaaacctatactctccaagatggcccctggagtcagcaagagagaaatcctgaggctccagggagggcagctgtcccaccgtgggggaagtatgatgctgccttgagaaccatgattcccttccgtcccaagccgaggtttcctgccccccagcccctggacaatgctggcctgttctcctacctcaccgtgtcatggctcaccccgctcatgatccaaagcttacggagtcgcttagatgagaacaccatccctccactgtcagtccatgatgcctcagacaaaaatgtccaaaggcttcaccgcctttgggaagaagaagtctcaaggcgagggattgaaaaagcttcagtgcttctggtgatgctgaggttccagagaacaaggttgattttcgatgcacttctgggcatctgcttctgcattgccagtgtactcgggccaatattgattataccaaagatcctggaatattcagaagagcagttggggaatgttgtccatggagtgggactctgctttgccctttttctctccgaatgtgtgaagtctctgagtttctcctccagttggatcatcaaccaacgcacagccatcaggttccgagcagctgtttcctcctttgcctttgagaagctcatccaatttaagtctgtaatacacatcacctcaggagaggccatcagcttcttcaccggtgatgtaaactacctgtttgaaggggtgtgctatggacccctagtactgatcacctgcgcatcgctggtcatctgcagcatttcttcctacttcattattggatacactgcatttattgccatcttatgctatctcctggttttcccactggcggtattcatgacaagaatggctgtgaaggctcagcatcacacatctgaggtcagcgaccagcgcatccgtgtgaccagtgaagttctcacttgcattaagctgattaaaatgtacacatgggagaaaccatttgcaaaaatcattgaagacctaagaaggaaggaaaggaaactattggagaagtgcgggcttgtccagagcctgacaagtataaccttgttcatcatccccacagtggccacagcggtctgggttctcatccacacatccttaaagctgaaactcacagcgtcaatggccttcagcatgctggcctccttgaatctccttcggctgtcagtgttctttgtgcctattgcagtcaaaggtctcacgaattccaagtctgcagtgatgaggttcaagaagtttttcctccaggagagccctgttttctatgtccagacattacaagaccccagcaaagctctggtctttgaggaggccaccttgtcatggcaacagacctgtcccgggatcgtcaatggggcactggagctggagaggaacgggcatgcttctgaggggatgaccaggcctagagatgccctcgggccagaggaagaagggaacagcctgggcccagagttgcacaagatcaacctggtggtgtccaaggggatgatgttaggggtctgcggcaacacggggagtggtaagagcagcctgttgtcagccatcctggaggaggtaagtgatctgtggccacatgcttgcctgtctgcaggcagtccaggccctcccaagctccagtgccccaggcggggccccccactgctttcttcctcacaggggtctgagcaagtgggatttttataaatcaaaaatggttgtgcttgcactgtgcgggaggtgcgtgatcaaggtggccctctctcttcaccttgtggcagcgctcctggtgcaagctgcctcttatgtcacctggagacctgtcctcacctgtgctctgtgaggatacaggatattaacacaaagttaatatgatcatacaaattatttcacagagagttgagtctagtctctcttccacactgcaataccctcttgcaatggtccctat

SEQ ID NO: 285608 - DNA, 4863 bp, Homo sapiens
  misc_feature (3008)..(3008): n is a, c, g, or t
actgggataaagcaagaagactgattttatgagcaggggtttgatacatcaaaggagattgcccaggatcaagggtgcggtgttgggggtgggttggggagggtggttagagaaggtttcactaagtgatttgggcctgaggcctgagaagatgtttaaaaagagggatcaagcacaggctaaggagaggaaagagcaggcacccaaacctctgcatggccccaatatgctccctgcagggtagtgccccctcttctggctgctcaaggcgagatctaagcttcttctaactcctgctgtcttttcatattctctgattctgggaaacgaagaattggcaggaactgaaaatgactaggaagaggacatactgggtgcccaactcttctggtggcctcgtgaatcgtggcatcgacataggcgatgacatggtttcaggacttatttataaaacctatactctccaagatggcccctggagtcagcaagagagaaatcctgaggctccagggagggcagctgtcccaccgtgggggaagtatgatgctgccttgagaaccatgattcccttccgtcccaagccgaggtttcctgccccccagcccctggacaatgctggcctgttctcctacctcaccgtgtcatggctcaccccgctcatgatccaaagcttacggagtcgcttagatgagaacaccatccctccactgtcagtccatgatgcctcagacaaaaatgtccaaaggcttcaccgcctttgggaagaagaagtctcaaggcgagggattgaaaaagcttcagtgcttctggtgatgctgaggttccagagaacaaggttgattttcgatgcacttctgggcatctgcttctgcattgccagtgtactcgggccaatattgattataccaaagatcctggaatattcagaagagcagttggggaatgttgtccatggagtgggactctgctttgccctttttctctccgaatgtgtgaagtctctgagtttctcctccagttggatcatcaaccaacgcacagccatcaggttccgagcagctgtttcctcctttgcctttgagaagctcatccaatttaagtctgtaatacacatcacctcaggagaggccatcagcttcttcaccggtgatgtaaactacctgtttgaaggggtgtgctatggacccctagtactgatcacctgcgcatcgctggtcatctgcagcatttcttcctacttcattattggatacactgcatttattgccatcttatgctatctcctggttttcccactggcggtattcatgacaagaatggctgtgaaggctcagcatcacacatctgaggtcagcgaccagcgcatccgtgtgaccagtgaagttctcacttgcattaagctgattaaaatgtacacatgggagaaaccatttgcaaaaatcattgaagacctaagaaggaaggaaaggaaactattggagaagtgcgggcttgtccagagcctgacaagtataaccttgttcatcatccccacagtggccacagcggtctgggttctcatccacacatccttaaagctgaaactcacagcgtcaatggccttcagcatgctggcctccttgaatctccttcggctgtcagtgttctttgtgcctattgcagtcaaaggtctcacgaattccaagtctgcagtgatgaggttcaagaagtttttcctccaggagagccctgttttctatgtccagacattacaagaccccagcaaagctctggtctttgaggaggccaccttgtcatggcaacagacctgtcccgggatcgtcaatggggcactggagctggagaggaacgggcatgcttctgaggggatgaccaggcctagagatgccctcgggccagaggaagaagggaacagcctgggcccagagttgcacaagatcaacctggtggtgtccaaggggatgatgttaggggtctgcggcaacacggggagtggtaagagcagcctgttgtcagccatcctggaggagatgcacttgctcgagggctcggtgggggtgcagggaagcctggcctatgtcccccagcaggcctggatcgtcagcgggaacatcagggagaacatcctcatgggaggcgcatatgacaaggcccgatacctccaggtgctccactgctgctccctgaatcgggacctggaacttctgccctttggagacatgacagagattggagagcggggcctcaacctctctggggggcagaaacagaggatcagcctggcccgcgccgtctattccgaccgtcagatctacctgctggacgaccccctgtctgctgtggacgcccacgtggggaagcacatttttgaggagtgcattaagaagacactcagggggaagacggtcgtcctggtgacccaccagctgcagtacttagaattttgtggccagatcattttgttggaaaatgggaaaatctgtgaaaatggaactcacagtgagttaatgcagaaaaaggggaaatatgcccaacttatccagaagatgcacaaggaagccacttcggacatgttgcaggacacagcaaagatagcagagaagccaaaggtagaaagtcaggctctggccacctccctggaagagtctctcaacggaaatgctgtgccggagcatcagctcacacaggaggaggagatggaagaaggctccttgagttggagggtctaccaccactacatccaggcagctggaggttacatggtctcttgcataattttcttcttcgtggtgctgatcgtcttcttaacgatcttcagcttctggtggctgagctactggttggagcagggctcggggaccaatagcagccgagagagcaatggaaccatggcagacctgggcaacattgcagacaatcctcaactgtccttctaccagctggtgtacgggctcaacgccctgctcctcatctgtgtgggggtctgctcctcagggattttcaccaangtcacgaggaaggcatccacggccctgcacaacaagctcttcaacaaggttttccgctgccccatgagtttctttgacaccatcccaataggccggcttttgaactgcttcgcaggggacttggaacagctggaccagctcttgcccatcttttcagagcagttcctggtcctgtccttaatggtgatcgccgtcctgttgattgtcagtgtgctgtctccatatatcctgttaatgggagccataatcatggttatttgcttcatttattatatgatgttcaagaaggccatcggtgtgttcaagagactggagaactatagccggtctcctttattctcccacatcctcaattctctgcaaggcctgagctccatccatgtctatggaaaaactgaagacttcatcagccagtttaagaggctgactgatgcgcagaataactacctgctgttgtttctatcttccacacgatggatggcattgaggctggagatcatgaccaaccttgtgaccttggctgttgccctgttcgtggcttttggcatttcctccaccccctactcctttaaagtcatggctgtcaacatcgtgctgcagctggcgtccagcttccaggccactgcccggattggcttggagacagaggcacagttcacggctgtagagaggatactgcagtacatgaagatgtgtgtctcggaagctcctttacacatggaaggcacaagttgtccccaggggtggccacagcatggggaaatcatatttcaggattatcacatgaaatacagagacaacacacccaccgtgcttcacggcatcaacctgaccatccgcggccacgaagtggtgggcatcgtgggaaggacgggctctgggaagtcctccttgggcatggctctcttccgcctggtggagcccatggcaggccggattctcattgacggcgtggacatttgcagcatcggcctggaggacttgcggtccaagctctcagtgatccctcaagatccagtgctgctctcaggaaccatcagattcaacctagatccctttgaccgtcacactgaccagcagatctgggatgccttggagaggacattcctgaccaaggccatctcaaagttccccaaaaagctgcatacagatgtggtggaaaacggtggaaacttctctgtgggggagaggcagctgctctgcattgccagggctgtgcttcgcaactccaagatcatccttatcgatgaagccacagcctccattgacatggagacagacaccctgatccagcgcacaatccgtgaagccttccagggctgcaccgtgctcgtcattgcccaccgtgtcaccactgtgctgaactgtgaccacatcctggttatgggcaatgggaaggtggtagaatttgatcggccggaggtactgcggaagaagcctgggtcattgttcgcagccctcatggccacagccacttcttcactgagataaggagatgtggagacttcatggaggctggcagctgagctcagaggttcacacaggtgcagcttcgaggcccacagtctgcgaccttcttgtttggagatgagaacttctcctggaagcaggggtaaatgtagggggggtggggattgctggatggaaaccctggaataggctacttgatggctctcaagaccttagaaccccagaaccatctaagacatgggattcagtgatcatgtggttctccttttaacttacatgctgaataattttataataaggtaaaagcttatagttttctgatctgtgttagaagtgttgcaaatgctgtactgactttgtaaaatataaaactaaggaaaactca

SEQ ID NO: 285609 - DNA, 4933 bp, Homo sapiens
  misc_feature (3035)..(3035): n is a, c, g, or t
atgacgcccaggatggtgctttgcagcgacgtgcccttcagaaggcggctccgcaccagctgcaggttgcgggccgagtccacgctggtgcgcatggtggagccgggcagcaggacgccctcgtgggtgagcagcagcgggaggcgactggggatctggatggggctcactgatgacatgctggcagcctttcgcactgggggctgtcaaaaagagccagacagacagctgcccccggcctgccccgcagtcaccaaacctcagacccgcctccacgcctccgcttccggctacgcgctacggtccgtccccgggcccaaaagccatggcttcgcgctgctctctaggagagcctcccgaattggcaggaactgaaaatgactaggaagaggacatactgggtgcccaactcttctggtggcctcgtgaatcgtggcatcgacataggcgatgacatggtttcaggacttatttataaaacctatactctccaagatggcccctggagtcagcaagagagaaatcctgaggctccagggagggcagctgtcccaccgtgggggaagtatgatgctgccttgagaaccatgattcccttccgtcccaagccgaggtttcctgccccccagcccctggacaatgctggcctgttctcctacctcaccgtgtcatggctcaccccgctcatgatccaaagcttacggagtcgcttagatgagaacaccatccctccactgtcagtccatgatgcctcagacaaaaatgtccaaaggcttcaccgcctttgggaagaagaagtctcaaggcgagggattgaaaaagcttcagtgcttctggtgatgctgaggttccagagaacaaggttgattttcgatgcacttctgggcatctgcttctgcattgccagtgtactcgggccaatattgattataccaaagatcctggaatattcagaagagcagttggggaatgttgtccatggagtgggactctgctttgccctttttctctccgaatgtgtgaagtctctgagtttctcctccagttggatcatcaaccaacgcacagccatcaggttccgagcagctgtttcctcctttgcctttgagaagctcatccaatttaagtctgtaatacacatcacctcaggagaggccatcagcttcttcaccggtgatgtaaactacctgtttgaaggggtgtgctatggacccctagtactgatcacctgcgcatcgctggtcatctgcagcatttcttcctacttcattattggatacactgcatttattgccatcttatgctatctcctggttttcccactggcggtattcatgacaagaatggctgtgaaggctcagcatcacacatctgaggtcagcgaccagcgcatccgtgtgaccagtgaagttctcacttgcattaagctgattaaaatgtacacatgggagaaaccatttgcaaaaatcattgaagacctaagaaggaaggaaaggaaactattggagaagtgcgggcttgtccagagcctgacaagtataaccttgttcatcatccccacagtggccacagcggtctgggttctcatccacacatccttaaagctgaaactcacagcgtcaatggccttcagcatgctggcctccttgaatctccttcggctgtcagtgttctttgtgcctattgcagtcaaaggtctcacgaattccaagtctgcagtgatgaggttcaagaagtttttcctccaggagagccctgttttctatgtccagacattacaagaccccagcaaagctctggtctttgaggaggccaccttgtcatggcaacagacctgtcccgggatcgtcaatggggcactggagctggagaggaacgggcatgcttctgaggggatgaccaggcctagagatgccctcgggccagaggaagaagggaacagcctgggcccagagttgcacaagatcaacctggtggtgtccaaggggatgatgttaggggtctgcggcaacacggggagtggtaagagcagcctgttgtcagccatcctggaggagatgcacttgctcgagggctcggtgggggtgcagggaagcctggcctatgtcccccagcaggcctggatcgtcagcgggaacatcagggagaacatcctcatgggaggcgcatatgacaaggcccgatacctccaggtgctccactgctgctccctgaatcgggacctggaacttctgccctttggagacatgacagagattggagagcggggcctcaacctctctggggggcagaaacagaggatcagcctggcccgcgccgtctattccgaccgtcagatctacctgctggacgaccccctgtctgctgtggacgcccacgtggggaagcacatttttgaggagtgcattaagaagacactcagggggaagacggtcgtcctggtgacccaccagctgcagtacttagaattttgtggccagatcattttgttggaaaatgggaaaatctgtgaaaatggaactcacagtgagttaatgcagaaaaaggggaaatatgcccaacttatccagaagatgcacaaggaagccacttcggacatgttgcaggacacagcaaagatagcagagaagccaaaggtagaaagtcaggctctggccacctccctggaagagtctctcaacggaaatgctgtgccggagcatcagctcacacaggaggaggagatggaagaaggctccttgagttggagggtctaccaccactacatccaggcagctggaggttacatggtctcttgcataattttcttcttcgtggtgctgatcgtcttcttaacgatcttcagcttctggtggctgagctactggttggagcagggctcggggaccaatagcagccgagagagcaatggaaccatggcagacctgggcaacattgcagacaatcctcaactgtccttctaccagctggtgtacgggctcaacgccctgctcctcatctgtgtgggggtctgctcctcagggattttcaccaangtcacgaggaaggcatccacggccctgcacaacaagctcttcaacaaggttttccgctgccccatgagtttctttgacaccatcccaataggccggcttttgaactgcttcgcaggggacttggaacagctggaccagctcttgcccatcttttcagagcagttcctggtcctgtccttaatggtgatcgccgtcctgttgattgtcagtgtgctgtctccatatatcctgttaatgggagccataatcatggttatttgcttcatttattatatgatgttcaagaaggccatcggtgtgttcaagagactggagaactatagccggtctcctttattctcccacatcctcaattctctgcaaggcctgagctccatccatgtctatggaaaaactgaagacttcatcagccagtttaagaggctgactgatgcgcagaataactacctgctgttgtttctatcttccacacgatggatggcattgaggctggagatcatgaccaaccttgtgaccttggctgttgccctgttcgtggcttttggcatttcctccaccccctactcctttaaagtcatggctgtcaacatcgtgctgcagctggcgtccagcttccaggccactgcccggattggcttggagacagaggcacagttcacggctgtagagaggatactgcagtacatgaagatgtgtgtctcggaagctcctttacacatggaaggcacaagttgtccccaggggtggccacagcatggggaaatcatatttcaggattatcacatgaaatacagagacaacacacccaccgtgcttcacggcatcaacctgaccatccgcggccacgaagtggtgggcatcgtgggaaggacgggctctgtaggtttttactgagcacctactatgtgcctgggaaccgaaagggaagtcctccttgggcatggctctcttccgcctggtggagcccatggcaggccggattctcattgacggcgtggacatttgcagcatcggcctggaggacttgcggtccaagctctcagtgatccctcaagatccagtgctgctctcaggaaccatcagattcaacctagatccctttgaccgtcacactgaccagcagatctgggatgccttggagaggacattcctgaccaaggccatctcaaagttccccaaaaagctgcatacagatgtggtggaaaacggtggaaacttctctgtgggggagaggcagctgctctgcattgccagggctgtgcttcgcaactccaagatcatccttatcgatgaagccacagcctccattgacatggagacagacaccctgatccagcgcacaatccgtgaagccttccagggctgcaccgtgctcgtcattgcccaccgtgtcaccactgtgctgaactgtgaccacatcctggttatgggcaatgggaaggtggtagaatttgatcggccggaggtactgcggaagaagcctgggtcattgttcgcagccctcatggccacagccacttcttcactgagataaggagatgtggagacttcatggaggctggcagctgagctcagaggttcacacaggtgcagcttcgaggcccacagtctgcgaccttcttgtttggagatgagaacttctcctggaagcaggggtaaatgtagggggggtggggattgctggatggaaaccctggaataggctacttgatggctctcaagaccttagaaccccagaaccatctaagacatgggattcagtgatcatgtggttctccttttaacttacatgctgaataattttataataaggtaaaagcttatagttttctgatctgtgttagaagtgttgcaaatgctgtactgactttgtaaaatataaaactaaggaaaactca

SEQ ID NO: 285610 - DNA, 3049 bp, Homo sapiens
  misc_feature (1151)..(1151): n is a, c, g, or t
ggtccctggaactcgctggtgggcctggtagggccacattaaaagtcccttttacctaggagagcccccaaggtcctggagggcagtggggccctgggcactgtgcctgctgagccaggcaggctctgtcccttggcccaattggtcctgaggctggactcattctgccgcagatgcacttgctcgagggctcggtgggggtgcagggaagcctggcctatgtcccccagcaggcctggatcgtcagcgggaacatcagggagaacatcctcatgggaggcgcatatgacaaggcccgatacctccaggtgctccactgctgctccctgaatcgggacctggaacttctgccctttggagacatgacagagattggagagcggggcctcaacctctctggggggcagaaacagaggatcagcctggcccgcgccgtctattccgaccgtcagatctacctgctggacgaccccctgtctgctgtggacgcccacgtggggaagcacatttttgaggagtgcattaagaagacactcagggggaagacggtcgtcctggtgacccaccagctgcagtacttagaattttgtggccagatcattttgttggaaaatgggaaaatctgtgaaaatggaactcacagtgagttaatgcagaaaaaggggaaatatgcccaacttatccagaagatgcacaaggaagccacttcggacatgttgcaggacacagcaaagatagcagagaagccaaaggtagaaagtcaggctctggccacctccctggaagagtctctcaacggaaatgctgtgccggagcatcagctcacacaggaggaggagatggaagaaggctccttgagttggagggtctaccaccactacatccaggcagctggaggttacatggtctcttgcataattttcttcttcgtggtgctgatcgtcttcttaacgatcttcagcttctggtggctgagctactggttggagcagggctcggggaccaatagcagccgagagagcaatggaaccatggcagacctgggcaacattgcagacaatcctcaactgtccttctaccagctggtgtacgggctcaacgccctgctcctcatctgtgtgggggtctgctcctcagggattttcaccaangtcacgaggaaggcatccacggccctgcacaacaagctcttcaacaaggttttccgctgccccatgagtttctttgacaccatcccaataggccggcttttgaactgcttcgcaggggacttggaacagctggaccagctcttgcccatcttttcagagcagttcctggtcctgtccttaatggtgatcgccgtcctgttgattgtcagtgtgctgtctccatatatcctgttaatgggagccataatcatggttatttgcttcatttattatatgatgttcaagaaggccatcggtgtgttcaagagactggagaactatagccggtctcctttattctcccacatcctcaattctctgcaaggcctgagctccatccatgtctatggaaaaactgaagacttcatcagccagtttaagaggctgactgatgcgcagaataactacctgctgttgtttctatcttccacacgatggatggcattgaggctggagatcatgaccaaccttgtgaccttggctgttgccctgttcgtggcttttggcatttcctccaccccctactcctttaaagtcatggctgtcaacatcgtgctgcagctggcgtccagcttccaggccactgcccggattggcttggagacagaggcacagttcacggctgtagagaggatactgcagtacatgaagatgtgtgtctcggaagctcctttacacatggaaggcacaagttgtccccaggggtggccacagcatggggaaatcatatttcaggattatcacatgaaatacagagacaacacacccaccgtgcttcacggcatcaacctgaccatccgcggccacgaagtggtgggcatcgtgggaaggacgggctctgtaggtttttactgagcacctactatgtgcctgggaaccgaaagggaagtcctccttgggcatggctctcttccgcctggtggagcccatggcaggccggattctcattgacggcgtggacatttgcagcatcggcctggaggacttgcggtccaagctctcagtgatccctcaagatccagtgctgctctcaggaaccatcagattcaacctagatccctttgaccgtcacactgaccagcagatctgggatgccttggagaggacattcctgaccaaggccatctcaaagttccccaaaaagctgcatacagatgtggtggaaaacggtggaaacttctctgtgggggagaggcagctgctctgcattgccagggctgtgcttcgcaactccaagatcatccttatcgatgaagccacagcctccattgacatggagacagacaccctgatccagcgcacaatccgtgaagccttccagggctgcaccgtgctcgtcattgcccaccgtgtcaccactgtgctgaactgtgaccacatcctggttatgggcaatgggaaggtggtagaatttgatcggccggaggtactgcggaagaagcctgggtcattgttcgcagccctcatggccacagccacttcttcactgagataaggagatgtggagacttcatggaggctggcagctgagctcagaggttcacacaggtgcagcttcgaggcccacagtctgcgaccttcttgtttggagatgagaacttctcctggaagcaggggtaaatgtagggggggtggggattgctggatggaaaccctggaataggctacttgatggctctcaagaccttagaaccccagaaccatctaagacatgggattcagtgatcatgtggttctccttttaacttacatgctgaataattttataataaggtaaaagcttatagttttctgatctgtgttagaagtgttgcaaatgctgtactgactttgtaaaatataaaactaaggaaaactca

SEQ ID NO: 285611 - DNA, 4987 bp, Homo sapiens
  misc_feature (3035)..(3035): n is a, c, g, or t
atgacgcccaggatggtgctttgcagcgacgtgcccttcagaaggcggctccgcaccagctgcaggttgcgggccgagtccacgctggtgcgcatggtggagccgggcagcaggacgccctcgtgggtgagcagcagcgggaggcgactggggatctggatggggctcactgatgacatgctggcagcctttcgcactgggggctgtcaaaaagagccagacagacagctgcccccggcctgccccgcagtcaccaaacctcagacccgcctccacgcctccgcttccggctacgcgctacggtccgtccccgggcccaaaagccatggcttcgcgctgctctctaggagagcctcccgaattggcaggaactgaaaatgactaggaagaggacatactgggtgcccaactcttctggtggcctcgtgaatcgtggcatcgacataggcgatgacatggtttcaggacttatttataaaacctatactctccaagatggcccctggagtcagcaagagagaaatcctgaggctccagggagggcagctgtcccaccgtgggggaagtatgatgctgccttgagaaccatgattcccttccgtcccaagccgaggtttcctgccccccagcccctggacaatgctggcctgttctcctacctcaccgtgtcatggctcaccccgctcatgatccaaagcttacggagtcgcttagatgagaacaccatccctccactgtcagtccatgatgcctcagacaaaaatgtccaaaggcttcaccgcctttgggaagaagaagtctcaaggcgagggattgaaaaagcttcagtgcttctggtgatgctgaggttccagagaacaaggttgattttcgatgcacttctgggcatctgcttctgcattgccagtgtactcgggccaatattgattataccaaagatcctggaatattcagaagagcagttggggaatgttgtccatggagtgggactctgctttgccctttttctctccgaatgtgtgaagtctctgagtttctcctccagttggatcatcaaccaacgcacagccatcaggttccgagcagctgtttcctcctttgcctttgagaagctcatccaatttaagtctgtaatacacatcacctcaggagaggccatcagcttcttcaccggtgatgtaaactacctgtttgaaggggtgtgctatggacccctagtactgatcacctgcgcatcgctggtcatctgcagcatttcttcctacttcattattggatacactgcatttattgccatcttatgctatctcctggttttcccactggcggtattcatgacaagaatggctgtgaaggctcagcatcacacatctgaggtcagcgaccagcgcatccgtgtgaccagtgaagttctcacttgcattaagctgattaaaatgtacacatgggagaaaccatttgcaaaaatcattgaagacctaagaaggaaggaaaggaaactattggagaagtgcgggcttgtccagagcctgacaagtataaccttgttcatcatccccacagtggccacagcggtctgggttctcatccacacatccttaaagctgaaactcacagcgtcaatggccttcagcatgctggcctccttgaatctccttcggctgtcagtgttctttgtgcctattgcagtcaaaggtctcacgaattccaagtctgcagtgatgaggttcaagaagtttttcctccaggagagccctgttttctatgtccagacattacaagaccccagcaaagctctggtctttgaggaggccaccttgtcatggcaacagacctgtcccgggatcgtcaatggggcactggagctggagaggaacgggcatgcttctgaggggatgaccaggcctagagatgccctcgggccagaggaagaagggaacagcctgggcccagagttgcacaagatcaacctggtggtgtccaaggggatgatgttaggggtctgcggcaacacggggagtggtaagagcagcctgttgtcagccatcctggaggagatgcacttgctcgagggctcggtgggggtgcagggaagcctggcctatgtcccccagcaggcctggatcgtcagcgggaacatcagggagaacatcctcatgggaggcgcatatgacaaggcccgatacctccaggtgctccactgctgctccctgaatcgggacctggaacttctgccctttggagacatgacagagattggagagcggggcctcaacctctctggggggcagaaacagaggatcagcctggcccgcgccgtctattccgaccgtcagatctacctgctggacgaccccctgtctgctgtggacgcccacgtggggaagcacatttttgaggagtgcattaagaagacactcagggggaagacggtcgtcctggtgacccaccagctgcagtacttagaattttgtggccagatcattttgttggaaaatgggaaaatctgtgaaaatggaactcacagtgagttaatgcagaaaaaggggaaatatgcccaacttatccagaagatgcacaaggaagccacttcggacatgttgcaggacacagcaaagatagcagagaagccaaaggtagaaagtcaggctctggccacctccctggaagagtctctcaacggaaatgctgtgccggagcatcagctcacacaggaggaggagatggaagaaggctccttgagttggagggtctaccaccactacatccaggcagctggaggttacatggtctcttgcataattttcttcttcgtggtgctgatcgtcttcttaacgatcttcagcttctggtggctgagctactggttggagcagggctcggggaccaatagcagccgagagagcaatggaaccatggcagacctgggcaacattgcagacaatcctcaactgtccttctaccagctggtgtacgggctcaacgccctgctcctcatctgtgtgggggtctgctcctcagggattttcaccaangtcacgaggaaggcatccacggccctgcacaacaagctcttcaacaaggttttccgctgccccatgagtttctttgacaccatcccaataggccggcttttgaactgcttcgcaggggacttggaacagctggaccagctcttgcccatcttttcagagcagttcctggtcctgtccttaatggtgatcgccgtcctgttgattgtcagtgtgctgtctccatatatcctgttaatgggagccataatcatggttatttgcttcatttattatatgatgttcaagaaggccatcggtgtgttcaagagactggagaactatagccggtctcctttattctcccacatcctcaattctctgcaaggcctgagctccatccatgtctatggaaaaactgaagacttcatcagccagtttaagaggctgactgatgcgcagaataactacctgctgttgtttctatcttccacacgatggatggcattgaggctggagatcatgaccaaccttgtgaccttggctgttgccctgttcgtggcttttggcatttcctccaccccctactcctttaaagtcatggctgtcaacatcgtgctgcagctggcgtccagcttccaggccactgcccggattggcttggagacagaggcacagttcacggctgtagagaggatactgcagtacatgaagatgtgtgtctcggaagctcctttacacatggaaggcacaagttgtccccaggggtggccacagcatggggaaatcatatttcaggattatcacatgaaatacagagacaacacacccaccgtgcttcacggcatcaacctgaccatccgcggccacgaagtggtgggcatcgtgggaaggacgggctctgggaagtcctccttgggcatggctctcttccgcctggtggagcccatggcaggccggattctcattgacggcgtggacatttgcagcatcggcctggaggacttgcggtccaagctctcagtgatccctcaagatccagtgctgctctcaggaaccatcagattcaacctagatccctttgaccgtcacactgaccagcagatctgggatgccttggagaggacattcctgaccaaggccatctcaaagttccccaaaaagctgcatacagatgtggtggaaaacggtggaaacttctctgtgggggagaggcagctgctctgcattgccagggctgtgcttcgcaactccaagatcatccttatcgatgaagccacagcctccattgacatggagacagacaccctgatccagcgcacaatccgtgaagccttccagggctgcaccgtgctcgtcattgcccaccgtgtcaccactgtgctgaactgtgaccacatcctggttatgggcaatgggaaggtggtagaatttgatcggccggaggtactgcggaagaagcctgggtcattgttcgcagccctcatggccacagccacttcttcactgagataaggagatgtggagacttcatggaggctggcagctgagctcagaggttcacacaggtgcagcttcgaggcccacagtctgcgaccttcttgtttggagatgagaacttctcctggaagcagggattatgatgtctgattttcaaaaaatgccataaaaaatcaatttagtaaaccaatatttctcactctcttgcctgcactggtgctggggatgaaatggtgtccctgccctcagggaatttggaatctcgtgaggaactgctgtgggacactgccctcatcacgggtgagggagctctctacacactggccctccccaggccagatgcagctgccgtcttttccttgagcgaccagcagatggcagcctcgtcccaaaaatgcggtgatggccccactgggcttctgagctggccggatccccggagataattcgccacaaaagtgttgacccctggagtc

SEQ ID NO: 285612 - DNA, 510 bp, Homo sapiens
cagggtaccaatatgtgaataactatcattgtcttgttagcagtggggccctgactcacgtgaaggaattatagcattttgaggtggcacatgtttagttgatcacataaatatttaaaaaattgaaattcagatgaagtaataactattttttgatacttattttttgaaaaacaggatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaatgtggaaagagtt

SEQ ID NO: 285613 - DNA, 1967 bp, Homo sapiens
ctcccgcaagctcccgcagccccggcgctgcctcgctgacggctctccgccttccatggccgccatctgaacctgggcttcagctctgtccccagcctcccggggactcagattccctgaccctgatccgacccagaaattgagccagacacctcgggtggccttcgagtcaatctctgggcacactctgggtggccaccagcatctaacaaacggatgtctggaccctaagggccagggggtgaggggaagtggggcacactttttagacgatggtggggctgaggccggttgggcaggagatctgcctctgtctctccagtcacaggacagtctcctttcctctctgggcaaaactctaaggagctggagccatccctgggtccacagtgtgagaacgccaaggaagagcgttaacgtcatcgcgcccggccaagggcggccaggcaggcagcgaagatgccatcgcgccgaggtggcggccactgcgcctgcgcggtccacggcgcctgcgaacagcctgattcccgcgctttcttcgcgggcgggaagggcggcggttgctgacggggccgcctggacgacggttgacggaggcgagggaaactgagggcgaaagttgtgtgtcgtgttggcaggagggcctagaagggaaagactgtctagtgggacaatgtcatattataaatttggaatgctgaatagaaaattatagattttgatattgaaggaaatgaagcgaagcctaaatgaaaattcagctcgaagtacagcaggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccaatgagttcgggagctcaacaacaaaaacaattaagaacacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttgggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaatgtggaaagagtt

SEQ ID NO: 285614 - DNA, 1903 bp, Homo sapiens
ctcccgcaagctcccgcagccccggcgctgcctcgctgacggctctccgccttccatggccgccatctgaacctgggcttcagctctgtccccagcctcccggggactcagattccctgaccctgatccgacccagaaattgagccagacacctcgggtggccttcgagtcaatctctgggcacactctgggtggccaccagcatctaacaaacggatgtctggaccctaagggccagggggtgaggggaagtggggcacactttttagacgatggtggggctgaggccggttgggcaggagatctgcctctgtctctccagtcacaggacagtctcctttcctctctgggcaaaactctaaggagctggagccatccctgggtccacagtgtgagaacgccaaggaagagcgttaacgtcatcgcgcccggccaagggcggccaggcaggcagcgaagatgccatcgcgccgaggtggcggccactgcgcctgcgcggtccacggcgcctgcgaacagcctgattcccgcgctttcttcgcgggcgggaagggcggcggttgctgacggggccgcctggacgacggttgacggaggtctagtgggacaatgtcatattataaatttggaatgctgaatagaaaattatagattttgatattgaaggaaatgaagcgaagcctaaatgaaaattcagctcgaagtacagcaggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccaatgagttcgggagctcaacaacaaaaacaattaagaacacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttgggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaatgtggaaagagtt

SEQ ID NO: 285615 - DNA, 1890 bp, Homo sapiens
ctcccgcaagctcccgcagccccggcgctgcctcgctgacggctctccgccttccatggccgccatctgaacctgggcttcagctctgtccccagcctcccggggactcagattccctgaccctgatccgacccagaaattgagccagacacctcgggtggccttcgagtcaatctctgggcacactctgggtggccaccagcatctaacaaacggatgtctggaccctaagggccagggggtgaggggaagtggggcacactttttagacgatggtggggctgaggccggttgggcaggagatctgcctctgtctctccagtcacaggacagtctcctttcctctctgggcaaaactctaaggagctggagccatccctgggtccacagtgtgagaacgccaaggaagagcgttaacgtcatcgcgcccggccaagggcggccaggcaggcagcgaagatgccatcgcgccgaggtggcggccactgcgcctgcgcggtccacggcgcctgcgaacagcctgattcccgcgctttcttcgcgggcgggaagggcggcggttgctgacggggccgcctggacgacggttgacggaggcgagggaaactgagggcgaaagttgtgtgtcgtgttggcaggagggcctagaagggaaagactgtctagtgggacaatgtcatattataaatttggaatgctgaatagaaaattatagattttgatattgaaggaaatgaagcgaagcctaaatgaaaattcagctcgaagtacagcagaaaaagaggaacagacagccattaacttctaatccacttaaagatgattcagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccaatgagttcgggagctcaacaacaaaaacaattaagaacacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttgggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaatgtggaaagagtt

SEQ ID NO: 285616 - DNA, 1925 bp, Homo sapiens
ctcccgcaagctcccgcagccccggcgctgcctcgctgacggctctccgccttccatggccgccatctgaacctgggcttcagctctgtccccagcctcccggggactcagattccctgaccctgatccgacccagaaattgagccagacacctcgggtggccttcgagtcaatctctgggcacactctgggtggccaccagcatctaacaaacggatgtctggaccctaagggccagggggtgaggggaagtggggcacactttttagacgatggtggggctgaggccggttgggcaggagatctgcctctgtctctccagtcacaggacagtctcctttcctctctgggcaaaactctaaggagctggagccatccctgggtccacagtgtgagaacgccaaggaagagcgttaacgtcatcgcgcccggccaagggcggccaggcaggcagcgaagatgccatcgcgccgaggtggcggccactgcgcctgcgcggtccacggcgcctgcgaacagcctgattcccgcgctttcttcgcgggcgggaagggcggcggttgctgacggggccgcctggacgacggttgacggaggcgagggaaactgagggcgaaagtctagtgggacaatgtcatattataaatttggaatgctgaatagaaaattatagattttgatattgaaggaaatgaagcgaagcctaaatgaaaattcagctcgaagtacagcaggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccaatgagttcgggagctcaacaacaaaaacaattaagaacacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttgggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaatgtggaaagagtt

SEQ ID NO: 285617 - DNA, 1855 bp, Homo sapiens
ctcccgcaagctcccgcagccccggcgctgcctcgctgacggctctccgccttccatggccgccatctgaacctgggcttcagctctgtccccagcctcccggggactcagattccctgaccctgatccgacccagaaattgagccagacacctcgggtggccttcgagtcaatctctgggcacactctgggtggccaccagcatctaacaaacggatgtctggaccctaagggccagggggtgaggggaagtggggcacactttttagacgatggtggggctgaggccggttgggcaggagatctgcctctgtctctccagtcacaggacagtctcctttcctctctgggcaaaactctaaggagctggagccatccctgggtccacagtgtgagaacgccaaggaagagcgttaacgtcatcgcgcccggccaagggcggccaggcaggcagcgaagatgccatcgcgccgaggtggcggccactgcgcctgcgcggtccacggcgcctgcgaacagcctgattcccgcgctttcttcgcgggcgggaagggcggcggttgctgacggggccgcctggacgacggttgacggaggtctagtgggacaatgtcatattataaatttggaatgctgaatagaaaattatagattttgatattgaaggaaatgaagcgaagcctaaatgaaaattcagctcgaagtacagcaggctgtttgcctgttccgttgttcaatcagaaaaagaggaacagacagccattaacttctaatccacttaaagatgattcagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccaatgagttcgggagctcaacaacaaaaacaattaagaacacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttgggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaatgtggaaagagtt

SEQ ID NO: 285618 - DNA, 555 bp, Homo sapiens
agcccctcttccttctcttcagcctattcaatatgaagatggtgaggatgatgacctttatgatgatccacttccatttaatgaataacttattaaatcccaggtggcggtaattctctgtgaggtcaccctcaatgagaactattcgcacaggctgattctgcaattccttgatcacaggattattagatactgacacaacagtgatatatcctggacaaacacaagaagaagtttcaggtacatgaagagaaactacctcttcactacaaaagtttaagccttctgacattactgatactattatggaaatggggacaccaagatgaagacattcttcaactgcactgctccaagcaccaacaagaaacaaaagagtactgattccagttctatatgtgttgttttgtgcttgaactgcttcattgagaagttgtcccactgcactggttaaatccaaactttcaagaagccttactgttgaactgattaatacactttcatgacattcttcatctataataaatttggatgattttagtgggcctaggaaag

SEQ ID NO: 285619 - DNA, 4586 bp, Homo sapiens
agaacgatggcctttctgcggtgtctgcgaccgggaccaaggcggagcaaagtcgccgggggtgtggggtgttccacgctatgttgggagtgttcgctttcgagcttattgcaggagtgaccaggacactacctcctagaagtaatgcccacagaaagcgcaagttgttcgactgctcgccaaacaaaacagaagcgcaaatcccatagcctttctatacgaagaactaacagctcggagcaggagaggacgggactgccaagagacatgttagaaggacaagattctaaactgccttcctcggttcgcagtacacttctggaactgtttggtcaaatagaaagagaatttgaaaacctttatatcgaaaacttagaattacgtagagaaatcgacactcttaatgaacgtttagctgctgaaggacaagcgattgatggagcagagctgagtaagggccaactcaaaacaaaagccagtcacagcaccagccagctctcccagaaactgaagaccacttacaaggcttccaccagcaagattgtctccagctttaagaccacgacatcgagagctgcctgccagctcgtgaaggagtacatcggccaccgggacggcatctgggatgtcagcgtggccaagacacagccagtggtgctcgggactgcatcagccgatcacacggctttgctgtggagcatagagacagggaagtgcctagtcaagtacgcaggccacgtgggctcagtaaattctatcaaatttcatccctcagagcagttggctctcactgcttctggagatcagactgctcatatctggagatacgcggtgcagctgccgacaccccagcctgttgctgacactagtatatctggggaagatgaagtagagtgctctgacaaggacgagcccgacctcgatggggatgtgtccagcgactgccccaccatccgcgtcccactgacatccctcaagagccaccagggcgtggtcatcgcctccgactggctggttggggggaagcaggctgtgactgcctcctgggaccggacggcaaacctgtacgacgtggagacgtccgagctcgttcactctctgacagggcacgaccaggagttgacgcactgctgcacacaccccacccagcggctcgtggtgacctcctcccgtgacacgactttccgcctctgggatttcagggacccctccatccactcggtgaatgttttccagggacacacggacactgtgacttctgccgtgttcaccgtgggagacaacgtggtttcaggcagcgatgaccgcacggtgaaagtctgggacttgaaaaatatgagatcccccattgcaactattcgcacggactctgccattaacaggatcaatgtatgtgtcggccaaaaaatcatagccctcccccatgacaaccgacaagtgagactgtttgatatgtcaggagtgcgcctggcgcggcttccccggagcagccgacagggccacaggagaatggtatgctgctcggcatggagtgaagaccaccccgtgtgcaatctgttcacctgtgggtttgaccggcaagccattggttggaacatcaacatccctgcattgctacaagaaaaataaggacaccggcagcccttagtttcactgtttgccagcacagacctttgatgggtgcaggcttttctgcgtattaatcagccatttttgtgagagtttgaccctggaaagggtgctttgtatatgttcttttcacatagtgcccagcttgcatgaaatgtacagagaaatgtgtggtcgtattttttacttttgtcttgtatatgtatgtatattgggtcctctgggcagtagaggcaaagctcacctcccatgtagcacatgaaatgcttgtgagttgttgacattggacaggtgaacagtagggcattacatttgtgtgaattaaatgtgaacttctgtattacgttgcggcgtcggctgtcctgcgttccctggagtaactgtacgtatctgcctttgctgggaagactgtgaggctgcctgtgttggctggcgaccagcaggattgctccaggattttgtgtttacctcgcgtgaagttcagcacgtgctgtcgtgtagtcagcttctactctaatttctgttacagttctgcaaaggtaacctggagtttagaagttaaaaaaaagcatgggatgttggatttgcaccatttggagtttctttaggaaagaaaagttttctgcttttttatagaaaatcatttcagtctcctgaggtctcatgctagcaaattttgaaataggattctaatcactgatttcaaatattaagcaaaatgtaaagcactttaatttatagctatggttataaacaggttttagatgtttcaaatgacttgtccactgaatgtcacttgaccttgataagaggccgcctgcacacagagcccagttaattctccgcacctcggttgtgtgcttccgaatgggctcactcccgtggtggtgtttgagagccaacaacactacctcagagacgggtctttgggaaactttgggtctcactgttgcctggctggagcactttggtttatagctggaatactgagttcagttcagaaggcaggaaagacagtcacaccgacgtgtcctgaaggtgtaggctctccacttaggcgcacaagctgacggctgcagccagcaggccccggtgacgagacacttccaggtcttgtggtggggacgcctctcagtgccagtcccgccactgctgagtgagcctggtgttcttgccttcttggaaattactgctcacctggtatctgtacgttaatgtttcttgctgagttacagttttgataaagaggctctcatttcctgtgtcttgtatattcagtcctttcaatacgtccacctggaggctcaccacttggagagacacaggaaggtaatatttacagctgtcatgtgacatccccaggtctttgtgttttgccctgttttacggtgaggtaggagggaacccatctggggaccggtaggtgcaggtgcagtaggacgtgggacttttggacccgtcctttggtgcagctcgccagggatgagaggcacctccctacttgggtcttcaggagctggtccaaggagcttcgaatctaagtcatctagaatgaccctgaaatgactgacagccccgggcccaagaaaaacccataaccacctcagatggatctgacgtggctaagggacaaacagcaaatatttcagtcattttgattttacaaataaaaaatgtgttgtgtttttgtccgacattatttcctgactgcactgttctgagaatggagtccacctggtccctctggttgattagaatctcaggtttcagctcctgctgtcctgagcgaacttgcctgatgcagggctgtgctgtgtccagatgttgctggggcctcactttttctcttggctggaggtccaattgccagagcctcccacactgcacatacaaaggtctgagcccagggcagcttctggggccactgcacaggccacctgcttgggttcctcggagtttaatttgaaagtctgggtgtcttaggatgatggttaggaacattgaaaaatggctgcaaatagccaaatcaaacttaagaaccagatctctgccagattaaacatttttgaagcttttaaaagtcaatattcctagtggccactgagttccaggcacactggtgccctttactgccacagctgctcaccttgtctggcaaactggagggacctcagaaactggactcctgcatgtccttgggggcgcagccctgtggtgctcaggcagagctctcaggagccggggcaccttgctgttcgctgctgtgtcgtcttctaatgtgagctcatccactgctgctgcagcgtggtgatcaggagtcacagacaagatcggggatggtgtgtgtgtgcgtgtgtgtgtgtgtgtgtgtgcacgtgtgtgtggctaaattaagtcatactgtcaaccacacgtgatctcgtctgaaacagtgtttggaagtgggaacagttttgtcctgtatgctgatgtgtccagaatttcatttaatgatagacggaaaatgtgtggttactgaaaactgtatatgatacagaatttcataagagccatgctgttgggcaaagcaactctttttcaaccactgctcatcagtttctgtagagacaaaaactctgtacatattttggaatctgaagaatcctatgtaaatcatttgttacttaagtctgtgaaaaacatatttctttggaggaaaatgtatgcatttataagtgttccatggaatcagtttttattgtatcgatataattgtctctaagtgttgactgtcttcattgcaatatgaaattcattaaaatgtccatgttccataattactattataaaagctttgtgttattgggagtcttattatttttatagtttttcatgttttgctttggtgaaacattgtgaatgactatataaacatcacgatgagctagaaattgaacaaatataatactggtcactcg

SEQ ID NO: 285620 - DNA, 4462 bp, Homo sapiens
gcggtgtcctgcgcgtcttcgggtcagtacggggggccgcgtcgtagggactcactggcggtgcgcgacctgggctggctccgggggtggcgggcgcagctgctgtgacagcttattgcaggagtgaccaggacactacctcctagaagtaatgcccacagaaagcgcaagttgttcgactgctcgccaaacaaaacagaagcgcaaatcccatagcctttctatacgaagaactaacagctcggagcaggagaggacgggactgccaagagacatgttagaaggacaagattctaaactgccttcctcggttcgcagtacacttctggaactgtttggtcaaatagaaagagaatttgaaaacctttatatcgaaaacttagaattacgtagagaaatcgacactcttaatgaacgtttagctgctgaaggacaagcgattgatggagcagagctgagtaagggccaactcaaaacaaaagccagtcacagcaccagccagctctcccagaaactgaagaccacttacaaggcttccaccagcaagattgtctccagctttaagaccacgacatcgagagctgcctgccagctcgtgaaggagtacatcggccaccgggacggcatctgggatgtcagcgtggccaagacacagccagtggtgctcgggactgcatcagccgatcacacggctttgctgtggagcatagagacagggaagtgcctagtcaagtacgcaggccacgtgggctcagtaaattctatcaaatttcatccctcagagcagttggctctcactgcttctggagatcagactgctcatatctggagatacgcggtgcagctgccgacaccccagcctgttgctgacactagtatatctggggaagatgaagtagagtgctctgacaaggacgagcccgacctcgatggggatgtgtccagcgactgccccaccatccgcgtcccactgacatccctcaagagccaccagggcgtggtcatcgcctccgactggctggttggggggaagcaggctgtgactgcctcctgggaccggacggcaaacctgtacgacgtggagacgtccgagctcgttcactctctgacagggcacgaccaggagttgacgcactgctgcacacaccccacccagcggctcgtggtgacctcctcccgtgacacgactttccgcctctgggatttcagggacccctccatccactcggtgaatgttttccagggacacacggacactgtgacttctgccgtgttcaccgtgggagacaacgtggtttcaggcagcgatgaccgcacggtgaaagtctgggacttgaaaaatatgagatcccccattgcaactattcgcacggactctgccattaacaggatcaatgtatgtgtcggccaaaaaatcatagccctcccccatgacaaccgacaagtgagactgtttgatatgtcaggagtgcgcctggcgcggcttccccggagcagccgacagggccacaggagaatggtatgctgctcggcatggagtgaagaccaccccgtgtgcaatctgttcacctgtgggtttgaccggcaagccattggttggaacatcaacatccctgcattgctacaagaaaaataaggacaccggcagcccttagtttcactgtttgccagcacagacctttgatgggtgcaggcttttctgcgtattaatcagccatttttgtgagagtttgaccctggaaagggtgctttgtatatgttcttttcacatagtgcccagcttgcatgaaatgtacagagaaatgtgtggtcgtattttttacttttgtcttgtatatgtatgtatattgggtcctctgggcagtagaggcaaagctcacctcccatgtagcacatgaaatgcttgtgagttgttgacattggacaggtgaacagtagggcattacatttgtgtgaattaaatgtgaacttctgtattacgttgcggcgtcggctgtcctgcgttccctggagtaactgtacgtatctgcctttgctgggaagactgtgaggctgcctgtgttggctggcgaccagcaggattgctccaggattttgtgtttacctcgcgtgaagttcagcacgtgctgtcgtgtagtcagcttctactctaatttctgttacagttctgcaaaggtaacctggagtttagaagttaaaaaaaagcatgggatgttggatttgcaccatttggagtttctttaggaaagaaaagttttctgcttttttatagaaaatcatttcagtctcctgaggtctcatgctagcaaattttgaaataggattctaatcactgatttcaaatattaagcaaaatgtaaagcactttaatttatagctatggttataaacaggttttagatgtttcaaatgacttgtccactgaatgtcacttgaccttgataagaggccgcctgcacacagagcccagttaattctccgcacctcggttgtgtgcttccgaatgggctcactcccgtggtggtgtttgagagccaacaacactacctcagagacgggtctttgggaaactttgggtctcactgttgcctggctggagcactttggtttatagctggaatactgagttcagttcagaaggcaggaaagacagtcacaccgacgtgtcctgaaggtgtaggctctccacttaggcgcacaagctgacggctgcagccagcaggccccggtgacgagacacttccaggtcttgtggtggggacgcctctcagtgccagtcccgccactgctgagtgagcctggtgttcttgccttcttggaaattactgctcacctggtatctgtacgttaatgtttcttgctgagttacagttttgataaagaggctctcatttcctgtgtcttgtatattcagtcctttcaatacgtccacctggaggctcaccacttggagagacacaggaaggtaatatttacagctgtcatgtgacatccccaggtctttgtgttttgccctgttttacggtgaggtaggagggaacccatctggggaccggtaggtgcaggtgcagtaggacgtgggacttttggacccgtcctttggtgcagctcgccagggatgagaggcacctccctacttgggtcttcaggagctggtccaaggagcttcgaatctaagtcatctagaatgaccctgaaatgactgacagccccgggcccaagaaaaacccataaccacctcagatggatctgacgtggctaagggacaaacagcaaatatttcagtcattttgattttacaaataaaaaatgtgttgtgtttttgtccgacattatttcctgactgcactgttctgagaatggagtccacctggtccctctggttgattagaatctcaggtttcagctcctgctgtcctgagcgaacttgcctgatgcagggctgtgctgtgtccagatgttgctggggcctcactttttctcttggctggaggtccaattgccagagcctcccacactgcacatacaaaggtctgagcccagggcagcttctggggccactgcacaggccacctgcttgggttcctcggagtttaatttgaaagtctgggtgtcttaggatgatggttaggaacattgaaaaatggctgcaaatagccaaatcaaacttaagaaccagatctctgccagattaaacatttttgaagcttttaaaagtcaatattcctagtggccactgagttccaggcacactggtgccctttactgccacagctgctcaccttgtctggcaaactggagggacctcagaaactggactcctgcatgtccttgggggcgcagccctgtggtgctcaggcagagctctcaggagccggggcaccttgctgttcgctgctgtgtcgtcttctaatgtgagctcatccactgctgctgcagcgtggtgatcaggagtcacagacaagatcggggatggtgtgtgtgtgcgtgtgtgtgtgtgtgtgtgtgcacgtgtgtgtggctaaattaagtcatactgtcaaccacacgtgatctcgtctgaaacagtgtttggaagtgggaacagttttgtcctgtatgctgatgtgtccagaatttcatttaatgatagacggaaaatgtgtggttactgaaaactgtatatgatacagaatttcataagagccatgctgttgggcaaagcaactctttttcaaccactgctcatcagtttctgtagagacaaaaactctgtacatattttggaatctgaagaatcctatgtaaatcatttgttacttaagtctgtgaaaaacatatttctttggaggaaaatgtatgcatttataagtgttccatggaatcagtttttattgtatcgatataattgtctctaagtgttgactgtcttcattgcaatatgaaattcattaaaatgtccatgttccataattactattat

SEQ ID NO: 285621 - DNA, 639 bp, Homo sapiens
ttatgaatagacattcatcactatattagttttctgttctgctgtagcaaacttaaacttattttagtggcttaaactaacacagatttgtcatcttgcagttctgtgggtctggtataattcccacgaggactccgtctcaaaagtaaataaataaaaataaaaaataaaaaatacatggatcttatcattttccctacaccaagtacaccataaattgagaaaacattgatttacttttttattaatataccatcatttgaaaattgatgcatatactatatctgacttattaaagacaaatcaaaacaattttgaattagcttggctttaatttatcttttttttattttggaagtaatggccatatgtgcttaaaaatttatcagacagtataaaaagaaatctaccattacccctcaagcccatcgcactcttcaaaggaagacattttctgcatgtttttgcttttggttcttttggtggttagtcctgtgaatgtaagtaatcatcttctggttttagatctatccgctttagtgttaatgcttcacagtgaaataaacaggtcctttgcgctgctctattactttccagttttcctccttcagggtttgtgtttgtaaaatttatatatat

SEQ ID NO: 285622 - DNA, 532 bp, Homo sapiens
cagggcggtccctgaatgcggtctcagaaaagagttatttaagtaaaaagtacattcctctcactaagtggtcactaagctggaaaggtctgactgctgctgcttagccatagtggcggtgaagagcgcattttaccatggtctgtgccttgggtaattttccccgatttctctcttcagcttctggagatcagactgctcatatctggagatacgcggtgcagctgccgacaccccagcctgttgctgacactagtgtaagcacctttccttacctgtgaatgtgtaggatgctgatgtctgcgaatctgagaatccatttatgatatctgtcatggacggaatgtttgtgtccccccaagttcagtgttgaaggcctcacccccggtatggttgaatttggagattgggcctctaaggtagtagttaaggttcagtgaggttgcgtgaggtcctcataagaggagacagtggagagctcacctgtgttctcaatctctctgtcactctccgtgtcacgtaagagcagagc

SEQ ID NO: 285623 - DNA, 505 bp, Homo sapiens
gcatgatcgacgctcggtgccttcatagaggcacggagtgaatgctgtccacgtagttaacgctgtccatgtagttagttaacgctgttcacgtagctcttttctgccttttcacttagagctgtgtgtgtaccagtttcctgaccagactttgtttctgtttcctctcgcacgtgctgtgtggttccttcccccgcagtgccctcttcacttgctcactcgccctccctcacacctccacgctgccaggctgagaggtggcatcgcctgtgtgcacagagggacaggtgtgggtggggcccgtggctctgagcgcctgtctgcccgtccacagggccctgatgagctgtggagccttcccctcccctttcccaggacctcctctcctttggccattcctgctgtcacagtgtcttctctttcttgccctggacatttccccttagtgtgtagacaggctggcgcctttcccgtgttagaccccctcctccgtgctgccttctta

SEQ ID NO: 285624 - DNA, 455 bp, Homo sapiens
ttatgaatagacattcatcactatattagttttctgttctgctgtagcaaacttaaacttattttagtggcttaaactaacacagatttgtcatcttgcagttctgtgggtctggtataattcccacgaggactccgtctcaaaagtaaataaataaaaataaaaaataaaaaatacatggatcttatcattttccctacaccaagtacaccataaattgagaaaacattgatttacttttttattaatataccatcatttgaaaattgatgcatatactatatctgacttattaaagacaaatcaaaacaattttgaattagcttggctttaatttatcttttttttattttggaagtaatggccatatgtgcttaaaaatttatcagacagtataaaaagaaatctaccattaccctgaactttctatcaccacagataaagattttgttttg

SEQ ID NO: 285625 - DNA, 4652 bp, Homo sapiens
agccgaacactgaccgcgccgtccccgccaggctcccgcgcggccggcaccgcggccctgagcgcaggcggccccgggtctcaggcctcaggcggaccgcgccccgggctcgcagccctcccgccccggctgccgggctacggggcagatggactcggagcgccccgccgcttattgcaggagtgaccaggacactacctcctagaagtaatgcccacagaaagcgcaagttgttcgactgctcgccaaacaaaacagaagcgcaaatcccatagcctttctatacgaagaactaacagctcggagcaggagaggacgggactgccaagagacatgttagaaggacaagattctaaactgccttcctcggttcgcagtacacttctggaactgtttggtcaaatagaaagagaatttgaaaacctttatatcgaaaacttagaattacgtagagaaatcgacactcttaatgaacgtttagctgctgaaggacaagcgattgatggagcagagctgagtaagggccaactcaaaacaaaagccagtcacagcaccagccagctctcccagaaactgaagaccacttacaaggcttccaccagcaagattgtctccagctttaagaccacgacatcgagagctgcctgccagctcgtgaaggagtacatcggccaccgggacggcatctgggatgtcagcgtggccaagacacagccagtggtgctcgggactgcatcagccgatcacacggctttgctgtggagcatagagacagggaagtgcctagtcaagtacgcaggccacgtgggctcagtaaattctatcaaatttcatccctcagagcagttggctctcactgcttctggagatcagactgctcatatctggagatacgcggtgcagctgccgacaccccagcctgttgctgacactagtatatctggggaagatgaagtagagtgctctgacaaggacgagcccgacctcgatggggatgtgtccagcgactgccccaccatccgcgtcccactgacatccctcaagagccaccagggcgtggtcatcgcctccgactggctggttggggggaagcaggctgtgactgcctcctgggaccggacggcaaacctgtacgacgtggagacgtccgagctcgttcactctctgacagggcacgaccaggagttgacgcactgctgcacacaccccacccagcggctcgtggtgacctcctcccgtgacacgactttccgcctctgggatttcagggacccctccatccactcggtgaatgttttccagggacacacggacactgtgacttctgccgtgttcaccgtgggagacaacgtggtttcaggcagcgatgaccgcacggtgaaagtctgggacttgaaaaatatgagatcccccattgcaactattcgcacggactctgccattaacaggatcaatgtatgtgtcggccaaaaaatcatagccctcccccatgacaaccgacaagtgagactgtttgatatgtcaggagtgcgcctggcgcggcttccccggagcagccgacagggccacaggagaatggtatgctgctcggcatggagtgaagaccaccccgtgtgcaatctgttcacctgtgggtttgaccggcaagccattggttggaacatcaacatccctgcattgctacaagaaaaataaggacaccggcagcccttagtttcactgtttgccagcacagacctttgatgggtgcaggcttttctgcgtattaatcagccatttttgtgagagtttgaccctggaaagggtgctttgtatatgttcttttcacatagtgcccagcttgcatgaaatgtacagagaaatgtgtggtcgtattttttacttttgtcttgtatatgtatgtatattgggtcctctgggcagtagaggcaaagctcacctcccatgtagcacatgaaatgcttgtgagttgttgacattggacaggtgaacagtagggcattacatttgtgtgaattaaatgtgaacttctgtattacgttgcggcgtcggctgtcctgcgttccctggagtaactgtacgtatctgcctttgctgggaagactgtgaggctgcctgtgttggctggcgaccagcaggattgctccaggattttgtgtttacctcgcgtgaagttcagcacgtgctgtcgtgtagtcagcttctactctaatttctgttacagttctgcaaaggtaacctggagtttagaagttaaaaaaaagcatgggatgttggatttgcaccatttggagtttctttaggaaagaaaagttttctgcttttttatagaaaatcatttcagtctcctgaggtctcatgctagcaaattttgaaataggattctaatcactgatttcaaatattaagcaaaatgtaaagcactttaatttatagctatggttataaacaggttttagatgtttcaaatgacttgtccactgaatgtcacttgaccttgataagaggccgcctgcacacagagcccagttaattctccgcacctcggttgtgtgcttccgaatgggctcactcccgtggtggtgtttgagagccaacaacactacctcagagacgggtctttgggaaactttgggtctcactgttgcctggctggagcactttggtttatagctggaatactgagttcagttcagaaggcaggaaagacagtcacaccgacgtgtcctgaaggtgtaggctctccacttaggcgcacaagctgacggctgcagccagcaggccccggtgacgagacacttccaggtcttgtggtggggacgcctctcagtgccagtcccgccactgctgagtgagcctggtgttcttgccttcttggaaattactgctcacctggtatctgtacgttaatgtttcttgctgagttacagttttgataaagaggctctcatttcctgtgtcttgtatattcagtcctttcaatacgtccacctggaggctcaccacttggagagacacaggaaggtaatatttacagctgtcatgtgacatccccaggtctttgtgttttgccctgttttacggtgaggtaggagggaacccatctggggaccggtaggtgcaggtgcagtaggacgtgggacttttggacccgtcctttggtgcagctcgccagggatgagaggcacctccctacttgggtcttcaggagctggtccaaggagcttcgaatctaagtcatctagaatgaccctgaaatgactgacagccccgggcccaagaaaaacccataaccacctcagatggatctgacgtggctaagggacaaacagcaaatatttcagtcattttgattttacaaataaaaaatgtgttgtgtttttgtccgacattatttcctgactgcactgttctgagaatggagtccacctggtccctctggttgattagaatctcaggtttcagctcctgctgtcctgagcgaacttgcctgatgcagggctgtgctgtgtccagatgttgctggggcctcactttttctcttggctggaggtccaattgccagagcctcccacactgcacatacaaaggtctgagcccagggcagcttctggggccactgcacaggccacctgcttgggttcctcggagtttaatttgaaagtctgggtgtcttaggatgatggttaggaacattgaaaaatggctgcaaatagccaaatcaaacttaagaaccagatctctgccagattaaacatttttgaagcttttaaaagtcaatattcctagtggccactgagttccaggcacactggtgccctttactgccacagctgctcaccttgtctggcaaactggagggacctcagaaactggactcctgcatgtccttgggggcgcagccctgtggtgctcaggcagagctctcaggagccggggcaccttgctgttcgctgctgtgtcgtcttctaatgtgagctcatccactgctgctgcagcgtggtgatcaggagtcacagacaagatcggggatggtgtgtgtgtgcgtgtgtgtgtgtgtgtgtgtgcacgtgtgtgtggctaaattaagtcatactgtcaaccacacgtgatctcgtctgaaacagtgtttggaagtgggaacagttttgtcctgtatgctgatgtgtccagaatttcatttaatgatagacggaaaatgtgtggttactgaaaactgtatatgatacagaatttcataagagccatgctgttgggcaaagcaactctttttcaaccactgctcatcagtttctgtagagacaaaaactctgtacatattttggaatctgaagaatcctatgtaaatcatttgttacttaagtctgtgaaaaacatatttctttggaggaaaatgtatgcatttataagtgttccatggaatcagtttttattgtatcgatataattgtctctaagtgttgactgtcttcattgcaatatgaaattcattaaaatgtccatgttccataattactattataaaagctttgtgttattgggagtcttattatttttatagtttttcatgttttgctttggtgaaacattgtgaatgactatataaacatcacgatgagctagaaattgaacaaatataatactggtcactcg

SEQ ID NO: 285626 - DNA, 1225 bp, Homo sapiens
agccgaacactgaccgcgccgtccccgccaggctcccgcgcggccggcaccgcggccctgagcgcaggcggccccgggtctcaggcctcaggcggaccgcgccccgggctcgcagccctcccgccccggctgccgggctacggggcagatggactcggagcgccccgccgcttattgcaggagtgaccaggacactacctcctagaagtaatgcccacagaaagcgcaagttgttcgactgctcgccaaacaaaacagaagcgcaaatcccatagcctttctatacgaagaactaacagctcggagcaggagaggacgggactgccaagagacatgttagaaggacaagattctaaactgccttcctcggttcgcagtacacttctggaactgtttggtcaaatagaaagagaatttgaaaacctttatatcgaaaacttagaattacgtagagaaatcgacactcttaatgaacgtttagctgctgaaggacaagcgattgatggagcagagctgagtaagggccaactcaaaacaaaagccagtcacagcaccagccagctctcccagaaactgaagaccacttacaaggcttccaccagcaagattgtctccagctttaagaccacgacatcgagagctgcctgccagctcgtgaaggagtacatcggccaccgggacggcatctgggatgtcagcgtggccaagacacagccagtggtgctcgggactgcatcagccgatcacacggctttgctgtggagcatagagacagggaagtgcctagtcaagtacgcaggccacgtgggctcaggtaagcactgcctaaggagtgccgtagccagaggccgttgccttctccagtgtgtttttaaaatcgtgcatgataaagccagctgctactgtgtaggaagccttactgtttcggttgtcaggggacagtgtggtctgttcagagactgggataactctgtcttgagcttgtatgggctcaataacagggaaaagcttaactccctaaacaatgtacatatcatgttagtctgcattttatttaatattgtatataacccatatgtaggaaattttgtaactgaaatgtgtgcgttatttttcacaaaatacatatctgttttagaggtttacttttgatgtagtgataacttggatgtattcaataaaggatactccatgaatgtgcttgcgtgcccgtagttaatgctgt

SEQ ID NO: 285627 - DNA, 4438 bp, Homo sapiens
agctcagaggtctccaagccgcacggcctcgtcctctgctccacctttggcctgtgtctcccacgctcgctccctagacggagctcatttgttcaatgagcagtgattcggagtgggaccggtcagcatgttctgattctaaactgccttcctcggttcgcagtacacttctggaactgtttggtcaaatagaaagagaatttgaaaacctttatatcgaaaacttagaattacgtagagaaatcgacactcttaatgaacgtttagctgctgaaggacaagcgattgatggagcagagctgagtaagggccaactcaaaacaaaagccagtcacagcaccagccagctctcccagaaactgaagaccacttacaaggcttccaccagcaagattgtctccagctttaagaccacgacatcgagagctgcctgccagctcgtgaaggagtacatcggccaccgggacggcatctgggatgtcagcgtggccaagacacagccagtggtgctcgggactgcatcagccgatcacacggctttgctgtggagcatagagacagggaagtgcctagtcaagtacgcaggccacgtgggctcagtaaattctatcaaatttcatccctcagagcagttggctctcactgcttctggagatcagactgctcatatctggagatacgcggtgcagctgccgacaccccagcctgttgctgacactagtatatctggggaagatgaagtagagtgctctgacaaggacgagcccgacctcgatggggatgtgtccagcgactgccccaccatccgcgtcccactgacatccctcaagagccaccagggcgtggtcatcgcctccgactggctggttggggggaagcaggctgtgactgcctcctgggaccggacggcaaacctgtacgacgtggagacgtccgagctcgttcactctctgacagggcacgaccaggagttgacgcactgctgcacacaccccacccagcggctcgtggtgacctcctcccgtgacacgactttccgcctctgggatttcagggacccctccatccactcggtgaatgttttccagggacacacggacactgtgacttctgccgtgttcaccgtgggagacaacgtggtttcaggcagcgatgaccgcacggtgaaagtctgggacttgaaaaatatgagatcccccattgcaactattcgcacggactctgccattaacaggatcaatgtatgtgtcggccaaaaaatcatagccctcccccatgacaaccgacaagtgagactgtttgatatgtcaggagtgcgcctggcgcggcttccccggagcagccgacagggccacaggagaatggtatgctgctcggcatggagtgaagaccaccccgtgtgcaatctgttcacctgtgggtttgaccggcaagccattggttggaacatcaacatccctgcattgctacaagaaaaataaggacaccggcagcccttagtttcactgtttgccagcacagacctttgatgggtgcaggcttttctgcgtattaatcagccatttttgtgagagtttgaccctggaaagggtgctttgtatatgttcttttcacatagtgcccagcttgcatgaaatgtacagagaaatgtgtggtcgtattttttacttttgtcttgtatatgtatgtatattgggtcctctgggcagtagaggcaaagctcacctcccatgtagcacatgaaatgcttgtgagttgttgacattggacaggtgaacagtagggcattacatttgtgtgaattaaatgtgaacttctgtattacgttgcggcgtcggctgtcctgcgttccctggagtaactgtacgtatctgcctttgctgggaagactgtgaggctgcctgtgttggctggcgaccagcaggattgctccaggattttgtgtttacctcgcgtgaagttcagcacgtgctgtcgtgtagtcagcttctactctaatttctgttacagttctgcaaaggtaacctggagtttagaagttaaaaaaaagcatgggatgttggatttgcaccatttggagtttctttaggaaagaaaagttttctgcttttttatagaaaatcatttcagtctcctgaggtctcatgctagcaaattttgaaataggattctaatcactgatttcaaatattaagcaaaatgtaaagcactttaatttatagctatggttataaacaggttttagatgtttcaaatgacttgtccactgaatgtcacttgaccttgataagaggccgcctgcacacagagcccagttaattctccgcacctcggttgtgtgcttccgaatgggctcactcccgtggtggtgtttgagagccaacaacactacctcagagacgggtctttgggaaactttgggtctcactgttgcctggctggagcactttggtttatagctggaatactgagttcagttcagaaggcaggaaagacagtcacaccgacgtgtcctgaaggtgtaggctctccacttaggcgcacaagctgacggctgcagccagcaggccccggtgacgagacacttccaggtcttgtggtggggacgcctctcagtgccagtcccgccactgctgagtgagcctggtgttcttgccttcttggaaattactgctcacctggtatctgtacgttaatgtttcttgctgagttacagttttgataaagaggctctcatttcctgtgtcttgtatattcagtcctttcaatacgtccacctggaggctcaccacttggagagacacaggaaggtaatatttacagctgtcatgtgacatccccaggtctttgtgttttgccctgttttacggtgaggtaggagggaacccatctggggaccggtaggtgcaggtgcagtaggacgtgggacttttggacccgtcctttggtgcagctcgccagggatgagaggcacctccctacttgggtcttcaggagctggtccaaggagcttcgaatctaagtcatctagaatgaccctgaaatgactgacagccccgggcccaagaaaaacccataaccacctcagatggatctgacgtggctaagggacaaacagcaaatatttcagtcattttgattttacaaataaaaaatgtgttgtgtttttgtccgacattatttcctgactgcactgttctgagaatggagtccacctggtccctctggttgattagaatctcaggtttcagctcctgctgtcctgagcgaacttgcctgatgcagggctgtgctgtgtccagatgttgctggggcctcactttttctcttggctggaggtccaattgccagagcctcccacactgcacatacaaaggtctgagcccagggcagcttctggggccactgcacaggccacctgcttgggttcctcggagtttaatttgaaagtctgggtgtcttaggatgatggttaggaacattgaaaaatggctgcaaatagccaaatcaaacttaagaaccagatctctgccagattaaacatttttgaagcttttaaaagtcaatattcctagtggccactgagttccaggcacactggtgccctttactgccacagctgctcaccttgtctggcaaactggagggacctcagaaactggactcctgcatgtccttgggggcgcagccctgtggtgctcaggcagagctctcaggagccggggcaccttgctgttcgctgctgtgtcgtcttctaatgtgagctcatccactgctgctgcagcgtggtgatcaggagtcacagacaagatcggggatggtgtgtgtgtgcgtgtgtgtgtgtgtgtgtgtgcacgtgtgtgtggctaaattaagtcatactgtcaaccacacgtgatctcgtctgaaacagtgtttggaagtgggaacagttttgtcctgtatgctgatgtgtccagaatttcatttaatgatagacggaaaatgtgtggttactgaaaactgtatatgatacagaatttcataagagccatgctgttgggcaaagcaactctttttcaaccactgctcatcagtttctgtagagacaaaaactctgtacatattttggaatctgaagaatcctatgtaaatcatttgttacttaagtctgtgaaaaacatatttctttggaggaaaatgtatgcatttataagtgttccatggaatcagtttttattgtatcgatataattgtctctaagtgttgactgtcttcattgcaatatgaaattcattaaaatgtccatgttccataattactattataaaagctttgtgttattgggagtcttattatttttatagtttttcatgttttgctttggtgaaacattgtgaatgactatataaacatcacgatgagctagaaattgaacaaatataatactggtcactcg

SEQ ID NO: 285628 - DNA, 493 bp, Homo sapiens
agccgaacactgaccgcgccgtccccgccaggctcccgcgcggccggcaccgcggccctgagcgcaggcggccccgggtctcaggcctcaggcggaccgcgccccgggctcgcagccctcccgccccggctgccgggctacggggcagatggactcggagcgccccgccgcttattgcaggagtgaccaggacactacctcctagaagtaatgcccacagaaagcgcaagttgttcgactgctcgccaaacaaaacagaagcgcaaatcccatagcctttctatacgaagaactaacagctcggagcaggagaggacgggactgccaagagacatgttagaaggacaagattctaaactgccttcctcggttcgcagtacacttctggaactgtttggtcaaatagaaagagaatttgaaaacctttatatcgaaaacttagaatgtgagtatctcctattttaatatacttttatagctttacctatccata

SEQ ID NO: 285629 - DNA, 610 bp, Homo sapiens
tatttgtcttattctttcatttgaaaaactataaactgatgatagctaagttccgacttcttcatttccatcttgcagatcacacggctttgctgtggagcatagagacagggaagtgcctagtcaagtacgcaggccacgtgggctcaggtaagcactgcctaaggagtgccgtagccagaggccgttgccttctccagtgtgtttttaaaatcgtgcatgataaagccagctgctactgtgtaggaagccttactgtttcggttgtcaggggacagtgtggtctgttcagagactgggataactctgtcttgagcttgtatgggctcaataacagggaaaagcttaactccctaaacaatgtacatatcatgttagtctgcattttatttaatattgtatataacccatatgtaggaaattttgtaactgaaatgtgtgcgttatttttcacaaaatacatatctgttttagaggtttacttttgatgtagtgataacttggatgtattcaataaaggatactccatgaatgtgcttgcgtgcccgtagttaatgctgtccacggagtgaatgctgtccacgtagttaacgctgtccatgtagttagt

SEQ ID NO: 285630 - DNA, 524 bp, Homo sapiens
atcccatatcatactaggtagccatttatacaatttgatttatagtctccttggcagaaatttggaactttaaactctttaagcattttatatataaaaatatgtaataatacaaaataagagtttacaataaaagataattcactttggaaaaagcatatttgtacttagagtttttcattcattcattcattttaaacaaagtcttcttctgcaggattctaaactgccttcctcggttcgcagtacacttctggaactgtttggtcaaatagaaagagaatttgaaaacctttatatcgaaaacttagaatgtgagtatctcctattttaatatacttttatagctttacctatccatagtcaaatttatgaatagacattcatcactatattagttttctgttctgctgtagcaaacttaaacttattttagtggcttaaactaacacagatttgtcatcttgcagttctgtgggtctggtataattcccacgaggactccgtctcaaaagtaaataaat

SEQ ID NO: 285631 - DNA, 964 bp, Homo sapiens
accccgctcacctgcaccagcctccggagcagggggctgcggctgcgggcgccgctgcgcagaagtgccgccagcacagccatggtcgcagagggctgagtatcggctccacaggcgtagactagcggcctcctccccaaccccgcacccctagcggcccggcgcgggcaccgcccatcccgcttcctccaatagtcgcctctcagtcggcggcgattggccggcagccaagggcggggcggagcctggcgctgggacaccgcagcctgggccaggaaaggttgacgagtgaaggacgtggatggagacactggcgctggggtcaacgagcacctgacacgctgctggctcccgtgtccaccaagtctaacctgccggggccggtggtttatgtataagtagagcaaatcaaagtttggatcagcgctcctgaagttaggccatgaccaatccacaaagcaagctgttactcattttacgcactccaggacatcactattaaagatttctaagcttgggttatatccctgctcggcaccaattttaagtgtacgttggagagaagagacctgaataaaggatgccaactgtgattccagacctttacaaactgctggtgactgattcaaacctgaggctacaaatccctaatcatgagaccttaaaataccaaaatacttctatgctacagattaagagatcagttacataactatatcagagcaggagatttctgtgttgtttttaataaattcagatatggcataataaatattaggtatataaacattaagtgtgttagtaaacacacaatatgtttagtaaacacacttaatatgtttgttttgctattttggctctgcaatcataatgacctacctatctccataaattttttaaactattgaagcaacaattaatataagcttcatttttcaaaacaagctttccagccatatttaaa

SEQ ID NO: 285632 - DNA, 1789 bp, Homo sapiens
gatagctgcagcgactctcttaatttccccgctcagggggaggctggattttcttttcacttaactgcaggttatatccctgctcggcaccaattttaagtgtacgttggagagaagagacctgaataaaggatgccaactgtgattccagacctttacaaactgctggtaagattttttttttcatttttttttaaattagcaaatctgttgttaaattacttaaagaaaatttaacaatggcataggcaccttgtcaactaaatgattttcataaacaccaaaaagtagttaaaacttttgtatacataaccaaaaaaaaaaaaaaagaaaactgtacatttacagtatttgctgctgttcattccccaaaatacaattaggacataattggctattaaaaatttataaaatttaataaaaaactttgctatgaatgtagtgttacccacttttgcattaaattcaccttcataaatcaaaacatcatgactctcattcttaaattaaatgacccaaaattagaagttccaaaaaagttctgagaacaattatggtttaaaacaacaaacctaaatttttaaaatggacggcaatttttcctgtttcctcctttggcattcttgtattgggacaagcaaatacgccaatgctgaattatctgttaaacataagggccacaattactacaaaattatttcttctaaattccaaatatacccattatgaacagtcacctaattagagaaaactgtacgtattaattttagtttaattcttcacaatatgctcggtctaataattgacatttgctaccttaaagtgtaaaattttaaacaaaattccaatttcctataagtttcagaacaggcatttggctatactcagcaaaactctaaatgttttaaagttgctttccttccattcagcaggcagttcacaaagcctcttcggatggggacagatcctacgaaatgctcttgaaagcactccactgtaacataatactgtatgcctttctgtactccatttcctactatcttcaaaaaccatactttaaaaatattacttaacatcaaataagatataaaataatttgcaagaaaatttgaaacgtgcaccacaatgaataaaaatccacgttgagccattctttcctcaaggggaatcaattttctctttcaagttgttcacgtcctcaagtcctaaaatttccactactctgggtattcagttgccagcaactagttaagttgctactttggatagactgaaaggaacatggtaaatgttgccttctgacgatttaaaaaatgtttatttttaaaatatataaatatatatgtacatatatttggcaagtttactgctcgtattaagagtgcaacaattttgcttctgtttttcaggtcttatgttgtggtttttctcttacccctaggtgactgattcaaacctgaggctacaaatccctaatcatgagaccttaaaataccaaaatacttctatgctacagattaagagatcagttacataactatatcagagcaggagatttctgtgttgtttttaataaattcagatatggcataataaatattaggtatataaacattaagtgtgttagtaaacacacaatatgtttagtaaacacacttaatatgtttgttttgctattttggctctgcaatcataatgacctacctatctccataaattttttaaactattgaagcaacaattaatataagcttcatttttcaaaacaagctttccagccatatttaaa

SEQ ID NO: 285633 - DNA, 1025 bp, Homo sapiens
gatagctgcagcgactctcttaatttccccgctcagggggaggctggattttcttttcacttaactgcaggttatatccctgctcggcaccaattttaagtgtacgttggagagaagagacctgaataaaggatgccaactgtgattccagacctttacaaactgctggcagttcacaaagcctcttcggatggggacagatcctacgaaatgctcttgaaagcactccactgtaacataatactgtatgcctttctgtactccatttcctactatcttcaaaaaccatactttaaaaatattacttaacatcaaataagatataaaataatttgcaagaaaatttgaaacgtgcaccacaatgaataaaaatccacgttgagccattctttcctcaaggggaatcaattttctctttcaagttgttcacgtcctcaagtcctaaaatttccactactctgggtattcagttgccagcaactagttaagttgctactttggatagactgaaaggaacatggtaaatgttgccttctgacgatttaaaaaatgtttatttttaaaatatataaatatatatgtacatatatttggcaagtttactgctcgtattaagagtgcaacaattttgcttctgtttttcaggtcttatgttgtggtttttctcttacccctaggtgactgattcaaacctgaggctacaaatccctaatcatgagaccttaaaataccaaaatacttctatgctacagattaagagatcagttacataactatatcagagcaggagatttctgtgttgtttttaataaattcagatatggcataataaatattaggtatataaacattaagtgtgttagtaaacacacaatatgtttagtaaacacacttaatatgtttgttttgctattttggctctgcaatcataatgacctacctatctccataaattttttaaactattgaagcaacaattaatataagcttcatttttcaaaacaagctttccagccatatttaaa

SEQ ID NO: 285634 - DNA, 189 bp, Homo sapiens
agggaggagttatctggtccagaaaggggatcgtgacctttccccagattgggacagggagtgggactgtgatattctcttagctgcagggtaccttgggtagtaggctgtgtagtacttgtcttccggatggaacttgtttgacttctccgtgcatcagaagctctgggctacaccctagaccagtcc

SEQ ID NO: 285635 - DNA, 1636 bp, Homo sapiens
  misc_feature (1589)..(1589): n is a, c, g, or t
  misc_feature (1615)..(1615): n is a, c, g, or t
  misc_feature (1617)..(1621): n is a, c, g, or t
  misc_feature (1623)..(1623): n is a, c, g, or t
  misc_feature (1625)..(1626): n is a, c, g, or t
  misc_feature (1630)..(1631): n is a, c, g, or t
  misc_feature (1635)..(1635): n is a, c, g, or t
cccccgctccagcctggagatgacatcaggtttggaagcttgaagtcctgctccagagaaaggaagcaagacctgaaaagtcatcccaggtagagggcaggatggacctgtggtctgagtctttgtgctggttgtgtccttccctgccacctggtctctaaccgtggagaaagacacaggcctctgcctaagctgaggaaaggtcaaaactagcttttcaggaggacggggagcatagataggacagtgttggggcctgaacacatcatggtagaggactcatagtagtgggtgttgatccccagcagaagggctaaagggggaatgagtctccagcaccatgtctggtttgtctggcccaccagcccggcatggcccttgtccatcggcgttgctgcttttgttcctgctgggccccagcttggtcctcgccatctccttccatctgtccattaattctcacaactgcttccatgaggagatccacaaggacctactagtgactggcacatacgagatctctgaccagtctgggggcactggtggcctgtgcagccacctcaagatcacagattctgctggccatattttctactccaaaaagaatacaaccaaggggaaatttgcctttaccactgaagattatgacatgtttgaagtgtgttttgagagcaaggaaacagggcagatacctgaccaacttgtgatcctagacatgaagcatggagtggaggtgaaaaattacagagagattgcaaaagttgagaagctcaaaccattagaggtgaagctgcgacacctagaagacctttcagaatctattgttaatgattttgcctacatgaagaagagagaagaggagatggtgataccagtgagtcaacaaacacttgggtcctacacttcagcatcttttcaatgttctgcctcactggactagccacctggcaggtcttctacctgtgatgcttcttcaaggctaagaagttgattgagtaatgaataaggcatattctcctcccaccttttaccacagccagcagaacatcgctgggatgggcctggcctaaggcatcctaccagcagcaccatcaaggcatgtaggagctttcttgccagaaatgatctcttttggtgtgcgaggacatggggtaccacctacacccaacaagtcaatgagggacttctttttaatttggtaggattttgactggttttgcaacaacaggtctattattagagtcacctatgacaaaaaaaagggttacctagataatgccaaagtcagcatttgtcctgggttcccttgtgtgatctgtttgaaccaagttttcttttcttctcccacttgctcagcagtttgggcttccattctagttcttttaccaagatttttgtgtgaccaagttgacttcattcggattgccttctttcaatttccttgtgaaaacactcttaactttctctttacccttagctgaaatgtttacgtagcttctggtgatatcttttcatgattttatgtctcttaaaatggtgatggatgtgacacttcataaaagtgagctttaaactgtagataactcttnaagaaaatgtcattttagacaattanannnnntntnntcanntgtng

SEQ ID NO: 285636 - DNA, 3404 bp, Homo sapiens
acgggcggccggatttgcccggaggccgcacccgcctccggcggggctctcagtgaaaaatgtactctgacctgaatcctgaattttccttgatggtcaaaagattaagaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtacgttctgtttctgaaacacagaatatagaatcccagaagattcactcctctagactgagtgatataactagctctaatatgcaaatatgtggatttaaaagcacagttccgcatttcaccgaagaagaaaagtatcaaaagcttctcagtgaaaataaaattagagatgaacagcctaaacatcagccagatatatgtggtaagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaacgcagtagataagtcaaggtctgaagcagcagttaggaaggtctcagaccttaaaatatcaactgatacagaatttctcagtataattacctccagccaggttgcttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtgggccagtctgaagctctatctagagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacagatgttgttattcatgaggaccaatggattggcgagacagtactacaatcaacatttagcagtcagttattaaatcttgggagttattcatctattcagcctgaagaatattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggagtggttctgattaaagcccagatttcagagctggcatttcctattacagcatctcagaagatagcgctaaatgctcacagttctctgaagagtattttttcttctcttcccaacatcgtatatactggctgtgcaaaatgtggattggaactagaaacagatgagaacaggatctacaaacaatgttttagctgcttgccatttactatgaagaaaatatattataggccagcgttaatgactgccattgatggaagacatgatgtttgtatccgtgtagaatcaaagctgatagagaagattcttctcaacatttctgcagactgcctcaacagagtgatagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttcctttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtggttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatgaa

SEQ ID NO: 285637 - DNA, 2157 bp, Homo sapiens
  misc_feature (46)..(46): n is a, c, g, or t
  misc_feature (107)..(107): n is a, c, g, or t
  misc_feature (153)..(153): n is a, c, g, or t
  misc_feature (356)..(356): n is a, c, g, or t
  misc_feature (374)..(374): n is a, c, g, or t
  misc_feature (391)..(391): n is a, c, g, or t
  misc_feature (596)..(597): n is a, c, g, or t
  misc_feature (772)..(772): n is a, c, g, or t
  misc_feature (832)..(832): n is a, c, g, or t
  misc_feature (972)..(972): n is a, c, g, or t
  misc_feature (994)..(994): n is a, c, g, or t
  misc_feature (997)..(998): n is a, c, g, or t
  misc_feature (1164)..(1164): n is a, c, g, or t
  misc_feature (1170)..(1170): n is a, c, g, or t
cttttttgcataatgtaaattagtctttatctcttagagaagcatnattctcatatcacatatacttcagtgttttgtccattcttgagacaattaaagttgtactncttggcattaattagattgtgatcataagtcaaaatgtcattggtnataaagtggtcatcagaccatgcagactattactaatattggttatgttttagtttattgcagtgaaaatacaaaatttaaaagttattgtagagaattatcataccccccaaaatatgtcattggtcctccaggactctgtagtccccatccaagaaagactgtgataattgtcaaggggttagtacggtctgagcatggtngatggtgctctgtcattntggtattgaacaacctnccaaatgtcttgattacatgtcctaaaaaagtgaggggaagagtgtaggacaaatgcaaaataaaataacacatttagctatacttttagtattttttattattgagattcaatatttaagtgaccgattcaagattcttttatataaaaaatgaatatatgcataagtaactgtgataagaactgtggatggataagagcactnntctgatgtactgcagcataaccagaactgctgtcggtctgaacggtgtgttatctgggcctgtttcttgtgtcagggggatcacatgccgtcactctggagtgcctcaatagcttgtaactagaaagagaaggtatagaaagagtagtttacttacctgtttatttatttagagncagagtcttgctctgttgcccaggctggagtgcagtggcacaatctcagctcattgcaanctctacctcctgggttcaagcaaatctcctgcctcagcttcccgagtagctgggattacaggcatgtgccaccactcccggctaatttttgtatttttagtagagacagggttttactgtgttggccaggcatgtctcgnactcctgacctcaagtaatccngcnncctccgtctcccagagtgctgggattacaggtgtgagccaccgctactggacgggaggagaaatttaaaatgggtttgagacttgaggaaccaaaagaaacaatgaaaccattcaatgtgtgtgctcctgtcaagctagcagcgatcttgggagctctgtgttttngtcttntgcagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttcctttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtggttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatgaa

SEQ ID NO: 285638 - DNA, 1114 bp, Homo sapiens
agctagcgagcgagaggcagccgcgcccgccgccgcccctgctctgtatgccgctctctcccggcgcggccgccgccgatcacagcagcaggagccgccgccgccgcggttgatgtggttgggccggggctgaggaggccgccaagatgccgcagtcaaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatctttaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttggaaataagaaagacctgcatatggaaagggtgatcagttatgaagaagggaaagctttggcagaatcttggaatgcagcttttttggaatcttctgctaaagaaaatcagactgctgttgatgtttttcgaaggatgattttggaggcagaaaaaatggacggggcagcttcacaaggcaagtcttcatgctcggtgatgtgattctgctgcaaagccccgaggacactgggaatatattcctagctgaagaagcaaactgcccgttctccttggagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttattggcattaatttttcagtgtagtttgttgtttaaaataatgtaatcatcaaaatgatgcatattgttacactactattaactaggcttcaatatatcagtgtttatttcattgtgttaaatgtatacttgcaaataaaatagctgcaaacctcaa

SEQ ID NO: 285639 - DNA, 3611 bp, Homo sapiens
acgggcggccggatttgcccggaggccgcacccgcctccggcggggctctcagtgaaaaatgtactctgacctgaatcctgaattttccttgatggtcaaaagattaagaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtacgttctgtttctgaaacacagaatatagaatcccagaagattcactcctctagactgagtgatataactagctctaatatgcaaatatgtggatttaaaagcacagttccgcatttcaccgaagaagaaaagtatcaaaagcttctcagtgaaaataaaattagagatgaacagcctaaacatcagccagatatatgtggtaagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaacgcagtagataagtcaaggtctgaagcagcagttaggaaggtctcagaccttaaaatatcaactgatacagaatttctcagtataattacctccagccaggttgcttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtgggccagtctgaagctctatctagagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacagatgttgttattcatgaggaccaatggattggcgagacagtactacaatcaacatttagcagtcagttattaaatcttgggagttattcatctattcagcctgaagaatattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggttatatttgggaatttaaatatctttttgttcagtgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggagtggttctgattaaagcccagatttcagagctggcatttcctattacagcatctcagaagatagcgctaaatgctcacagttctctgaagagtattttttcttctcttcccaacatcgtatatactggctgtgcaaaatgtggattggaactagaaacagatgagaacaggatctacaaacaatgttttagctgcttgccatttactatgaagaaaatatattataggccagcgttaatgactgccattgatggaagacatgatgtttgtatccgtgtagaatcaaagctgatagagaagattcttctcaacatttctgcagactgcctcaacagagtgatagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttcctttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtggttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatgaa

SEQ ID NO: 285640 - DNA, 3838 bp, Homo sapiens
ctccaccagcttgtcctccacgatgctggcgccgcgatcgaagaagccctccaccatcttgaagaagttggggtcgtcctcgcggtcggccaccgcctcgctgtagtggcgccgggcggccaatgccagccccggctgcggggcggcggcgggctgtccccgggcccagcccagcaacgcggccgagtcggcggacgccgagcccagggcagcgggcccggcccgggacagcaacagcgcttcgcccaggtagcggtacatggccacaagcggaggggagtgaaaaatgtactctgacctgaatcctgaattttccttgatggtcaaaagattaagaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtacgttctgtttctgaaacacagaatatagaatcccagaagattcactcctctagactgagtgatataactagctctaatatgcaaatatgtggatttaaaagcacagttccgcatttcaccgaagaagaaaagtatcaaaagcttctcagtgaaaataaaattagagatgaacagcctaaacatcagccagatatatgtggtaagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaacgcagtagataagtcaaggtctgaagcagcagttaggaaggtctcagaccttaaaatatcaactgatacagaatttctcagtataattacctccagccaggttgcttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtgggccagtctgaagctctatctagagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacagatgttgttattcatgaggaccaatggattggcgagacagtactacaatcaacatttagcagtcagttattaaatcttgggagttattcatctattcagcctgaagaatattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggttatatttgggaatttaaatatctttttgttcagtgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggagtggttctgattaaagcccagatttcagagctggcatttcctattacagcatctcagaagatagcgctaaatgctcacagttctctgaagagtattttttcttctcttcccaacatcgtatatactggctgtgcaaaatgtggattggaactagaaacagatgagaacaggatctacaaacaatgttttagctgcttgccatttactatgaagaaaatatattataggccagcgttaatgactgccattgatggaagacatgatgtttgtatccgtgtagaatcaaagctgatagagaagattcttctcaacatttctgcagactgcctcaacagagtgatagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttcctttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtggttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatgaa

SEQ ID NO: 285641 - DNA, 3784 bp, Homo sapiens
ctccaccagcttgtcctccacgatgctggcgccgcgatcgaagaagccctccaccatcttgaagaagttggggtcgtcctcgcggtcggccaccgcctcgctgtagtggcgccgggcggccaatgccagccccggctgcggggcggcggcgggctgtccccgggcccagcccagcaacgcggccgagtcggcggacgccgagcccagggcagcgggcccggcccgggacagcaacagcgcttcgcccaggtagcggtacatggccacaagcggaggggagtgaaaaatgtactctgacctgaatcctgaattttccttgatggtcaaaagattaagaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaaaaactgtatgaatagacatgttcatgtgaaagatgactttgtacgttctgtttctgaaacacagaatatagaatcccagaagattcactcctctagactgagtgatataactagctctaatatgcaaatatgtggatttaaaagcacagttccgcatttcaccgaagaagaaaagtatcaaaagcttctcagtgaaaataaaattagagatgaacagcctaaacatcagccagatatatgtggtaagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaacgcagtagataagtcaaggtctgaagcagcagttaggaaggtctcagaccttaaaatatcaactgatacagaatttctcagtataattacctccagccaggttgcttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtgggccagtctgaagctctatctagagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacagatgttgttattcatgaggaccaatggattggcgagacagtactacaatcaacatttagcagtcagttattaaatcttgggagttattcatctattcagcctgaagaatattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggttatatttgggaatttaaatatctttttgttcagtgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggagtggttctgattaaagcccagatttcagagctggcatttcctattacagcatctcagaagatagcgctaaatgctcacagttctctgaagagtattttttcttctcttcccaacatcgtatatactggctgtgcaaaatgtggattggaactagaaacagatgagaacaggatctacaaacaatgttttagctgcttgccatttactatgaagaaaatatattataggccagcgttaatgactgccattgatggaagacatgatgtttgtatccgtgtagaatcaaagctgatagagaagattcttctcaacatttctgcagactgcctcaacagagtgatagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttcctttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtggttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatgaa

SEQ ID NO: 285642 - DNA, 2539 bp, Homo sapiens
agctagcgagcgagaggcagccgcgcccgccgccgcccctgctctgtatgccgctctctcccggcgcggccgccgccgatcacagcagcaggagccgccgccgccgcggttgatgtggttgggccggggctgaggaggccgccaagatgccgcagtcaaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatctttaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttggaaataagaaagacctgcatatggaaagggtgatcagttatgaagaagggaaagctttggcagaatcttggaatgcagcttttttggaatcttctgctaaagaaaatcagactgctgttgatgtttttcgaaggatgattttggaggcagaaaaaatggacggggcagcttcacaagattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggttatatttgggaatttaaatatctttttgttcagtgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggagtggttctgattaaagcccagatttcagagctggcatttcctattacagcatctcagaagatagcgctaaatgctcacagttctctgaagagtattttttcttctcttcccaacatcgtatatactggctgtgcaaaatgtggattggaactagaaacagatgagaacaggatctacaaacaatgttttagctgcttgccatttactatgaagaaaatatattataggccagcgttaatgactgccattgatggaagacatgatgtttgtatccgtgtagaatcaaagctgatagagaagattcttctcaacatttctgcagactgcctcaacagagtgatagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttcctttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtggttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatgaa

SEQ ID NO: 285643 - DNA, 3967 bp, Homo sapiens
acgggcggccggatttgcccggaggccgcacccgcctccggcggggctctcagtgaaaaatgtactctgacctgaatcctgaattttccttgatggtcaaaagattaagaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtacgttctgtttctgaaacacagaatatagaatcccagaagattcactcctctagactgagtgatataactagctctaatatgcaaatatgtggatttaaaagcacagttccgcatttcaccgaagaagaaaagtatcaaaagcttctcagtgaaaataaaattagagatgaacagcctaaacatcagccagatatatgtggtaagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaacgcagtagataagtcaaggtctgaagcagcagttaggaaggtctcagaccttaaaatatcaactgatacagaatttctcagtataattacctccagccaggttgcttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtgggccagtctgaagctctatctagagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacagatgttgttattcatgaggaccaatggattggcgagacagtactacaatcaacatttagcagtcagttattaaatcttgggagttattcatctattcagcctgaagaatattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggttatatttgggaatttaaatatctttttgttcagtgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggagtggttctgattaaagcccagatttcagagctggcatttcctattacagcatctcagaagatagcgctaaatgctcacagttctctgaagagtattttttcttctcttcccaacatcgtatatactggctgtgcaaaatgtggattggaactagaaacagatgagaacaggatctacaaacaatgttttagctgcttgccatttactatgaagaaaatatattataggccagcgttaatgactgccattgatggaagacatgatgtttgtatccgtgtagaatcaaagctgatagagaagattcttctcaacatttctgcagactgcctcaacagagtgatagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttcctttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtggttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatgaaaaaaaaaaaaaaaaaaaaaaaaaaaaaaaaaaaaaaaaaaaaaaaaaaaaaaaaaaaaaaaaaaaaaaaaaaaaaaaaacagtgtcggcgcgggcgggccgcgccacacaaaaaagacttctaacaaaacatctgggggggggacgggcgcgccaccatgtagaataagaagacaggagaggacagcacggccccacagagaaaccgggggaacaaaaaagaggggggtacttcagccagaaaaaaaaagggcggggggagacaacgacgcgtgtgcaaaaaaccccaagaagaagtctgagacacatggaggggtaaaaaaagggggccacgaggacgaataaaaaagccccggg

SEQ ID NO: 285644 - DNA, 3557 bp, Homo sapiens
acgggcggccggatttgcccggaggccgcacccgcctccggcggggctctcagtgaaaaatgtactctgacctgaatcctgaattttccttgatggtcaaaagattaagaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtacgttctgtttctgaaacacagaatatagaatcccagaagattcactcctctagactgagtgatataactagctctaatatgcaaatatgtggatttaaaagcacagttccgcatttcaccgaagaagaaaagtatcaaaagcttctcagtgaaaataaaattagagatgaacagcctaaacatcagccagatatatgtggtaagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaacgcagtagataagtcaaggtctgaagcagcagttaggaaggtctcagaccttaaaatatcaactgatacagaatttctcagtataattacctccagccaggttgcttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtgggccagtctgaagctctatctagagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacagatgttgttattcatgaggaccaatggattggcgagacagtactacaatcaacatttagcagtcagttattaaatcttgggagttattcatctattcagcctgaagaatattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggttatatttgggaatttaaatatctttttgttcagtgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggagtggttctgattaaagcccagatttcagagctggcatttcctattacagcatctcagaagatagcgctaaatgctcacagttctctgaagagtattttttcttctcttcccaacatcgtatatactggctgtgcaaaatgtggattggaactagaaacagatgagaacaggatctacaaacaatgttttagctgcttgccatttactatgaagaaaatatattataggccagcgttaatgactgccattgatggaagacatgatgtttgtatccgtgtagaatcaaagctgatagagaagattcttctcaacatttctgcagactgcctcaacagagtgatagttccttcctcagagatcacctatgggatggtcgtggcagacctgttccactccttgttggcagtcagcgcagaaccttgtgtattaaagattcagagcctttttgtgttagatgttgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttcctttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtggttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatgaa

SEQ ID NO: 285645 - DNA, 3264 bp, Homo sapiens
acgggcggccggatttgcccggaggccgcacccgcctccggcggggctctcagtgaaaaatgtactctgacctgaatcctgaattttccttgatggtcaaaagattaagaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtacgttctgtttctgaaacacagaatatagaatcccagaagattcactcctctagactgagtgatataactagctctaatatgcaaatatgtggatttaaaagcacagttccgcatttcaccgaagaagaaaagtatcaaaagcttctcagtgaaaataaaattagagatgaacagcctaaacatcagccagatatatgtggtaagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaacgcagtagataagtcaaggtctgaagcagcagttaggaaggtctcagaccttaaaatatcaactgatacagaatttctcagtataattacctccagccaggttgcttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtgggccagtctgaagctctatctagagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacagatgttgttattcatgaggaccaatggattggcgagacagtactacaatcaacatttagcagtcagttattaaatcttgggagttattcatctattcagcctgaagaatattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggttatatttgggaatttaaatatctttttgttcagtgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggagtggttctgattaaagcccagatttcagagctggcatttcctattacagcatctcagaagatagcgctaaatgctcacagttctctgaagagtattttttcttctcttcccaacatcgtatatactggctgtgcaaaatgtggattggaactagaaacagatgagaacaggatctacaaacaatgttttagctgcttgccatttactatgaagaaaatatattataggccagcgttaatgactgccattgatggaagacatgatgtttgtatccgtgtagaatcaaagctgatagagaagattcttctcaacatttctgcagactgcctcaacagagtgatagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttcctttctcctggagaaatgatctaccagtcaaggcaatatgtagcagatccctgggaattaaaggtttgcccatttgttcactgtatttagtccctgctacattccaggcattgtactaagtatggggaaccacagagaagacattccccaaacgtggcgggtcgctatctactacggatggaatcttcttgtttactatggaggtagtttaacctgtcgtgggcttctg

SEQ ID NO: 285646 - DNA, 3040 bp, Homo sapiens
acgggcggccggatttgcccggaggccgcacccgcctccggcggggctctcagtgaaaaatgtactctgacctgaatcctgaattttccttgatggtcaaaagattaagaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtacgttctgtttctgaaacacagaatatagaatcccagaagattcactcctctagactgagtgatataactagctctaatatgcaaatatgtggatttaaaagcacagttccgcatttcaccgaagaagaaaagtatcaaaagcttctcagtgaaaataaaattagagatgaacagcctaaacatcagccagatatatgtggtaagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaacgcagtagataagtcaaggtctgaagcagcagttaggaaggtctcagaccttaaaatatcaactgatacagaatttctcagtataattacctccagccaggttgcttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtgggccagtctgaagctctatctagagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacagatgttgttattcatgaggaccaatggattggcgagacagtactacaatcaacatttagcagtcagttattaaatcttgggagttattcatctattcagcctgaagaatattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggttatatttgggaatttaaatatctttttgttcagtgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggagtggttctgattaaagcccagatttcagagctggcatttcctattacagcatctcagaagatagcgctaaatgctcacagttctctgaagagtattttttcttctcttcccaacatcgtatatactggctgtgcaaaatgtggattggaactagaaacagatgagaacaggatctacaaacaatgttttagctgcttgccatttactatgaagaaaatatattataggccagcgttaatgactgccattgatggaagacatgatgtttgtatccgtgtagaatcaaagctgatagagaagattcttctcaacatttctgcagactgcctcaacagagtgatagatggagttttgctcttgttgcctagactggagtgctgtggcgcgatctcagttcaccataacctctgcctcctggattcaagcaagtctcctgcctcagtttcccaagtagctgggattacagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcattcaggagaatacctccaatggttgtgcttgaatatattcttccttttgggtgtttcctgttgc

SEQ ID NO: 285647 - DNA, 1999 bp, Homo sapiens
acgggcggccggatttgcccggaggccgcacccgcctccggcggggctctcagtgaaaaatgtactctgacctgaatcctgaattttccttgatggtcaaaagattaagaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtacgttctgtttctgaaacacagaatatagaatcccagaagattcactcctctagactgagtgatataactagctctaatatgcaaatatgtggatttaaaagcacagttccgcatttcaccgaagaagaaaagtatcaaaagcttctcagtgaaaataaaattagagatgaacagcctaaacatcagccagatatatgtggtaagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaacgcagtagataagtcaaggtctgaagcagcagttaggaaggtctcagaccttaaaatatcaactgatacagaatttctcagtataattacctccagccaggttgcttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtgggccagtctgaagctctatctagagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacaggtgaggtcattatggtataatggtagcttattttataaagctaagttttgtttgtttttgtttttctcccacttagtctttgaagactctttctttagtcatttgcctcttctgagctcagcataattgatccctttattgcatctgcattgctctcctttccattgtccactctcctgcccattgccacttctgggcctctgttctatccttctcagctctgccccttctttccacttatcccctcctttaataagccttccctagtcaggtggagtgggtcacacttgtaatcccagcactttgggaggctgaggcaggaagattgcttgaggccaggaatttgagaccagccttggc

SEQ ID NO: 285648 - DNA, 510 bp, Homo sapiens
gttgatttcactatactgacaggtaaacattttgactgcctccttaattttagattatgaaaaaattaagatacaagaccatcttagtgtaccatttggttatcactatatatgtatcatcagctattaaagtatggtatcatgtgtgatagagtaatgccaactaagatactcattttccttttccagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggtaaatacaccaaaaagcatttaacctatttatatttcggtaaatgattaatgtttatgagcccaagatggagaaaatcttaagagacgagacagcatttgaaatacaagtgatcatgattgaatattcttctgcaaatttcttctgttaaaattttgtacctcttgtagcaattcatttatctaa

SEQ ID NO: 285649 - DNA, 1041 bp, Homo sapiens
  misc_feature (4)..(4): n is a, c, g, or t
  misc_feature (6)..(7): n is a, c, g, or t
  misc_feature (9)..(9): n is a, c, g, or t
ggcncnngngaggtgagagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgaaaaaacaaaaaaaaaccgggctcaaggcgggggcaaaaacggcagcgaccgccggtctagcggttccgggccgttctggacaagggaatcgcgggtcccaaaggagcgttatcgaagcggtacgaa

SEQ ID NO: 285650 - DNA, 915 bp, Homo sapiens
  misc_feature (4)..(4): n is a, c, g, or t
  misc_feature (6)..(7): n is a, c, g, or t
  misc_feature (9)..(9): n is a, c, g, or t
ggcncnngngaggtgagagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatga

SEQ ID NO: 285651 - DNA, 941 bp, Homo sapiens
  misc_feature (4)..(4): n is a, c, g, or t
  misc_feature (6)..(7): n is a, c, g, or t
  misc_feature (9)..(9): n is a, c, g, or t
ggcncnngngaggtgagagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgaaaaaaaaaaggggggggcaaagaacc

SEQ ID NO: 285652 - DNA, 902 bp, Homo sapiens
aaggctaggtacgaggccctcggggtaatcggccgaggtaagatgagcgggtggcagcgacagagccaaaatcagagctggaacctgaggagagagtgttcaagaaggaagtgtatcttcatacatcaccacacctgaaagcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatga

SEQ ID NO: 285653 - DNA, 749 bp, Homo sapiens
  misc_feature (27)..(28): n is a, c, g, or t
cttacggctagtacgaggctgggtgtnnagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatga

SEQ ID NO: 285654 - DNA, 1122 bp, Homo sapiens
  misc_feature (4)..(4): n is a, c, g, or t
  misc_feature (6)..(7): n is a, c, g, or t
  misc_feature (9)..(9): n is a, c, g, or t
ggcncnngngaggtgagagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcaggcatcagaccagcttgccaacttgtggcatagactgtttgctacatggagcttgttccagccactccccattatcctgcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgaaaaaacaaaaaaaaaccgggctcaaggcgggggcaaaaacggcagcgaccgccggtctagcggttccgggccgttctggacaagggaatcgcgggtcccaaaggagcgttatcgaagcggtacgaa

SEQ ID NO: 285655 - DNA, 1194 bp, Homo sapiens
agctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagatgttcaagaaggaagtgtatcttcatacatcaccacacctgaaagcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgaaaaaacaaaaaaaaaccgggctcaaggcgggggcaaaaacggcagcgaccgccggtctagcggttccgggccgttctggacaagggaatcgcgggtcccaaaggagcgttatcgaagcggtacgaa

SEQ ID NO: 285656 - DNA, 1308 bp, Homo sapiens
  misc_feature (4)..(4): n is a, c, g, or t
  misc_feature (6)..(7): n is a, c, g, or t
  misc_feature (9)..(9): n is a, c, g, or t
ggcncnngngaggtgagagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcaggtaaacttaacctacccttttccaaaaattttaaacggcaggacagtaaatattttagatgttaaaagtcctatagtctctagcgtgactcttcatctctgccactgtagcaccaaagcagccataaacaatatgtaaataaacagatgtggctgtattccagtacaactttacctacaaaaacaggcatcagaccagcttgccaacttgtggcatagactgtttgctacatggagcttgttccagccactccccattatcctgcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgaaaaaacaaaaaaaaaccgggctcaaggcgggggcaaaaacggcagcgaccgccggtctagcggttccgggccgttctggacaagggaatcgcgggtcccaaaggagcgttatcgaagcggtacgaa

SEQ ID NO: 285657 - DNA, 1062 bp, Homo sapiens
  misc_feature (4)..(4): n is a, c, g, or t
  misc_feature (6)..(7): n is a, c, g, or t
  misc_feature (9)..(9): n is a, c, g, or t
ggcncnngngaggtgagagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagccactccccattatcctgcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgaaaaaacaaaaaaaaaccgggctcaaggcgggggcaaaaacggcagcgaccgccggtctagcggttccgggccgttctggacaagggaatcgcgggtcccaaaggagcgttatcgaagcggtacgaa

SEQ ID NO: 285658 - DNA, 1045 bp, Homo sapiens
tggtgactggaagtgtcctaatcccacctgtgagaatatgaacttctcttggaggaatgaatgcaaccagtgtaaggcccctaaaccagatggcccaggagggggaccaggtggctctcacatgggggtgttcaagaaggaagtgtatcttcatacatcaccacacctgaaagcagatgtgcttttccagactgatccaactgcagagatggcagctgagtcattgcctttctcctttgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgaaaagaaaaaaaaaaattcgggctatatgtggggggggacaagggtttgaatggccagtgtaagggtttcggaccttttgtaagggaaatcgcggcccaaggagaaacgaac

SEQ ID NO: 285659 - DNA, 1035 bp, Homo sapiens
tattcccagcagagcagtcagccctacggacagcagagttacagtggttatagccagtccacggacacttcaggctatggccagagcagctattcttcttatggccagagccagaacatgttcaagaaggaagtgtatcttcatacatcaccacacctgaaagcagatgtgcttttccagactgatccaactgcagagatggcagctgagtcattgcctttctcctttgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgaaaagaaaaaaaaaaattcgggctatatgtggggggggacaagggtttgaatggccagtgtaagggtttcggaccttttgtaagggaaatcgcggcccaaggagaaacgaac

SEQ ID NO: 285660 - DNA, 881 bp, Homo sapiens
  misc_feature (4)..(4): n is a, c, g, or t
  misc_feature (6)..(7): n is a, c, g, or t
  misc_feature (9)..(9): n is a, c, g, or t
ggcncnngngaggtgagagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgaaaaaaaaaaggggggggcaaagaacc

SEQ ID NO: 285661 - DNA, 2202 bp, Homo sapiens
aacgccttcagcctgtttcccaggaacggtccccggcttcgcgccccaatttctaacagcctgcctgtcccccgggaacgttctaacatccttggggagcgccccagctacaagacactgtcctgagaacgctgtcatcacccgtagttgcaagtttcggagcggcagtgggaagcatgcgggactacgacgaggtgatcgccttcctgggcgagtgggggcccttccagcgcctcatcttcttcctgctcagcgccagcatcatccccaatggcttcaatggtatgtcagtcgtgttcctggcggggaccccggagcaccgctgtcgagtgccggacgccgcgaacctgagcagcgcctggcgcaacaacagtgtcccgctgcggctgcgggacggccgcgaggtgccccacagctgcagccgctaccggctcgccaccatcgccaacttctcggcgctcgggctggagccggggcgcgacgtggacctggggcagctggagcaggagagctgcctggatggctgggagttcagccaggacgtctacctgtccaccgtcgtgaccgagtggaatctggtgtgtgaggacaactggaaggtgcccctcaccacctccctgttcttcgtaggcgtgctcctcggctccttcgtgtccgggcagctgtcagacaggtttggcaggaagaacgttctcttcgcaaccatggctgtacagactggcttcagcttcctgcagattttctccatcagctgggagatgttcactgtgttatttgtcatcgtgggcatgggccagatctccaactatgtggtagccttcatactaggaacagaaattcttggcaagtcagttcgtattatattctctacattaggagtgtgcacattttttgcagttggctatatgctgctgccactgtttgcttacttcatcagagactggcggatgctgctgctggcgctgacggtgccgggagtgctgtgtgtcccgctgtggtggttcattcctgaatctccccgatggctgatatcccagagaagatttagagaggctgaagatatcatccaaaaagctgcaaaaatgaacaacatagctgtaccagcagtgatatttgattctgtggaggagctaaatcccctgaagcagcagaaagctttcattctggacctgttcaggactcggaatattgccataatgaccattatgtctttgctgctatggatgctgacctcagtgggttactttgctctgtctctggatgctcctaatttacatggagatgcctacctgaactgtttcctctctgccttgattgaaattccagcttacattacagcctggctgctattgcgaacgctgcccaggcgttatatcatagctgcagtactgttctggggaggaggtgtgcttctcttcattcaactggtacctgtggattattacttcttatccattggtctggtcatgctgggaaaatttgggatcacctctgctttctccatgctgtatgtcttcactgctgagctctacccaaccctggtcaggaacatggcggtgggggtcacatccacggcctccagagtgggcagcatcattgccccctactttgtttacctcggtgcttacaacagaatgctgccctacatcgtcatgggtagtctgactgtcctgattggaatcctcaccctttttttccctgaaagtttgggaatgactcttccagaaaccttagagcagatgcagaaagtgaaatggttcagatctgggaaaaaaacaagagactcaatggagacagaagaaaatcccaaggttctaataactgcattctgaaaaaatatctaccccatttggtgaagtgaaaaacagaaaaataagaccctgtggagaaattcgttgttcccactgaaatggactgactgtaacgattgacaccaaaatgaaccttgctatcaagaaatgctcgtcatacagtaaactctggatgattcttccagataatgtccttgctttacaaaccaaccatttctagagagtctccttactcattaattcaatgaaatggattggtaagatgtcttgaaaacatgttagtcaaggactggtaaaatacatataaagattaacactcatttccaatcatacaaatactatccaaataaaaataacatcattgtattaacgcaaatattaggtgacaaca

SEQ ID NO: 285662 - DNA, 2385 bp, Homo sapiens
aacgccttcagcctgtttcccaggaacggtccccggcttcgcgccccaatttctaacagcctgcctgtcccccgggaacgttctaacatccttggggagcgccccagctacaagacactgtcctgagaacgctgtcatcacccgtagttgcaagtttcggagcggcagtgggaagcatgcgggactacgacgaggtgatcgccttcctgggcgagtgggggcccttccagcgcctcatcttcttcctgctcagcgccagcatcatccccaatggcttcaatggtatgtcagtcgtgttcctggcggggaccccggagcaccgctgtcgagtgccggacgccgcgaacctgagcagcgcctggcgcaacaacagtgtcccgctgcggctgcgggacggccgcgaggtgccccacagctgcagccgctaccggctcgccaccatcgccaacttctcggcgctcgggctggagccggggcgcgacgtggacctggggcagctggagcaggagagctgcctggatggctgggagttcagccaggacgtctacctgtccaccgtcgtgaccgagtggaatctggtgtgtgaggacaactggaaggtgcccctcaccacctccctgttcttcgtaggcgtgctcctcggctccttcgtgtccgggcagctgtcagacaggtttggcaggaagaacgttctcttcgcaaccatggctgtacagactggcttcagcttcctgcagattttctccatcagctgggagatgttcactgtgttatttgtcatcgtgggcatgggccagatctccaactatgtggtagccttcatactaggaacagaaattcttggcaagtcagttcgtattatattctctacattaggagtgtgcacattttttgcagttggctatatgctgctgccactgtttgcttacttcatcagagactggcggatgctgctgctggcgctgacggtgccgggagtgctgtgtgtcccgctgtggtggagctggtccatgaatgctcctggctgtgggcatactgtaccagggacaggacttgccccagacagaggccagcctgggaccagcactgacaagctgagtgctccccctgaacatttaccagtggtcttaccattttcctataaaagaaaatagctttcttctgaacatcccatccttggcaggttcattcctgaatctccccgatggctgatatcccagagaagatttagagaggctgaagatatcatccaaaaagctgcaaaaatgaacaacatagctgtaccagcagtgatatttgattctgtggaggagctaaatcccctgaagcagcagaaagctttcattctggacctgttcaggactcggaatattgccataatgaccattatgtctttgctgctatggatgctgacctcagtgggttactttgctctgtctctggatgctcctaatttacatggagatgcctacctgaactgtttcctctctgccttgattgaaattccagcttacattacagcctggctgctattgcgaacgctgcccaggcgttatatcatagctgcagtactgttctggggaggaggtgtgcttctcttcattcaactggtacctgtggattattacttcttatccattggtctggtcatgctgggaaaatttgggatcacctctgctttctccatgctgtatgtcttcactgctgagctctacccaaccctggtcaggaacatggcggtgggggtcacatccacggcctccagagtgggcagcatcattgccccctactttgtttacctcggtgcttacaacagaatgctgccctacatcgtcatgggtagtctgactgtcctgattggaatcctcaccctttttttccctgaaagtttgggaatgactcttccagaaaccttagagcagatgcagaaagtgaaatggttcagatctgggaaaaaaacaagagactcaatggagacagaagaaaatcccaaggttctaataactgcattctgaaaaaatatctaccccatttggtgaagtgaaaaacagaaaaataagaccctgtggagaaattcgttgttcccactgaaatggactgactgtaacgattgacaccaaaatgaaccttgctatcaagaaatgctcgtcatacagtaaactctggatgattcttccagataatgtccttgctttacaaaccaaccatttctagagagtctccttactcattaattcaatgaaatggattggtaagatgtcttgaaaacatgttagtcaaggactggtaaaatacatataaagattaacactcatttccaatcatacaaatactatccaaataaaaataacatcattgtattaacgcaaatattaggtgacaaca

SEQ ID NO: 285663 - DNA, 1845 bp, Homo sapiens
aacgccttcagcctgtttcccaggaacggtccccggcttcgcgccccaatttctaacagcctgcctgtcccccgggaacgttctaacatccttggggagcgccccagctacaagacactgtcctgagaacgctgtcatcacccgtagttgcaagtttcggagcggcagtgggaagcatgcgggactacgacgaggtgatcgccttcctgggcgagtgggggcccttccagcgcctcatcttcttcctgctcagcgccagcatcatccccaatggcttcaatggtatgtcagtcgtgttcctggcggggaccccggagcaccgctgtcgagtgccggacgccgcgaacctgagcagcgcctggcgcaacaacagtgtcccgctgcggctgcgggacggccgcgaggtgccccacagctgcagccgctaccggctcgccaccatcgccaacttctcggcgctcgggctggagccggggcgcgacgtggacctggggcagctggagcaggagagctgcctggatggctgggagttcagccaggacgtctacctgtccaccgtcgtgaccgagtggaatctggtgtgtgaggacaactggaaggtgcccctcaccacctccctgttcttcgtaggcgtgctcctcggctccttcgtgtccgggcagctgtcagacaggtttggcaggaagaacgttctcttcgcaaccatggctgtacagactggcttcagcttcctgcagattttctccatcagctgggagatgttcactgtgttatttgtcatcgtgggcatgggccagatctccaactatgtggtagccttcatactaggaacagaaattcttggcaagtcagttcgtattatattctctacattaggagtgtgcacattttttgcagttggctatatgctgctgccactgtttgcttacttcatcagagactggcggatgctgctgctggcgctgacggtgccgggagtgctgtgtgtcccgctgtggtggagctggtccatgaatgctcctggctgtgggcatactgtaccagggacaggacttgccccagacagaggccagcctgggaccagcactgacaagctgagtgctccccctgaacatttaccagtggtcttaccattttcctataaaagaaaatagctttcttctgaacatcccatccttggcaggttcattcctgaatctccccgatggctgatatcccagagaagatttagagaggctgaagatatcatccaaaaagctgcaaaaatgaacaacatagctgtaccagcagtgatatttgattctgtggaggagctaaatcccctgaagcagcagaaagctttcattctggacctgttcaggactcggaatattgccataatgaccattatgtctttgctgctatggatgctgacctcagtgggttactttgctctgtctctggatgctcctaatttacatggagatgcctacctgaactgtttcctctctgccttgattgaaattccagcttacattacagcctggctgctattgcgaacgctgcccaggcgttatatcatagctgcagtactgttctggggaggaggtgtgcttctcttcattcaactggtacctgtggtgagtggttctggtccagaagactctcatgaagttgcagtcaagctgtcagtagtcatctcgacacccaactgatgctgaaggagctacttccaagctcactcaaggttgttggtgggcctcagttcctcattaaatgttggctagagacttcattccttgacatcacatggacccctcaaagggctgcttataacatgacagcttgcttgtctctgagcaagag

SEQ ID NO: 285664 - DNA, 1979 bp, Homo sapiens
aacagagaaaaaccctgagatgttttattgcttcagattcactgataaaggcttacagcttgagtacagaagagacagtggattacggagtggatgcgggtggttcctaaacactggacacaataaatgctaataccatgactagtgtgagatgcaggagtaagttaagtacaacaaaaaatatccttttcaaggatcccaaatgggcattatttttcaggttcaggatataaagcccacctgtatcctagaattaggcattgaaggataggccttaagaaaggatgctccaaaataccagtttggctacagagcagagtcagtgactgtttagaacaggtttggttccacctccagatcagggaatggcaggaatggtgggatgtgtctgcccgtgggtttgcttacaccttctaccccgggacatgaaagggctgggtatagaagcactttctgtgagtatttggaatgatgcccagaaatttatttttgctctcaaccagagtaattaaggggaagtgaaatcattcaaagagaagtaaaacaactcacttctctggaggataccagttagcctctgctaaccagaaccagccgaaggtaggcaggaattataaaagaactttaagcagctgaaagtgttaatacaaattctatgtactgaaaacacaaaagcctatttattcctactcttctagcttgctaatgcaaggtaatctagtttcctagcacacagcagattagaagtgatgcggggacctgacagaggcaggctcaatgatggcaggctaaaggtcatagggagaagttgcagccgatagtctacagatggacagtctggccatgtcatatcactcaagacatctgtgtggcatctaaaatcagtacaggcgatgccgttgctgttcatttgatggtaacctctccccgccatcggagcagagcaagcatcacactttgcagttctgccctccaagtatctaggacagcttttctcacctgcttgccttttgtcattcatttaaaagtaaggccaaaaagacaaaatagggtgaccaaccatcttgatttgcccaggaccaagggatacaggaccctcagtgccacaaattgggaaatccccagccatccaggatgagttggtcatctttggcacaactttctgagtgatgtaaatatattttgcttgggttagtgattatatggatgtatatacagttgtcaaaactcattgatgtgaacacttcaagatctgtgcattttattatatagaaattctacatcaataaaggctaattccttttgctcaggagtactgagtctgaatcaggtcctaagtatttcagatgtaagtaaaagaacactttaggggttagaaacaacttttggattgataagtttacataacatttacttgatctgtgtattacataatggcattggagatagacagacctgtgatggaatcccaccccgtcatatgctgactgactctgtactactaacctcttgataccttttttcctcatctagataattaggctgaccagttcatagggttgtaatggattaaatgtaaggaataagtggtaaatgtattgaagagcaggtagataatgagcagccaaaaattacagatatcacttgttgtaccttatagctaaagtgagagggagaaagcaaaactataaattaatgaattagacttctttcaccacagttctgttgggaagactatgtaactgttagctcaatgagggggttctctgaaaccttagcacgcatcagaatcaccaggagggattattaaaacaaatctgggccccacccatggagtttctgattcagtagggctgggctaggcctgagaatgtgcaggcctaacgctcccaggtgatgacagtgcttgttgggtccgggtactacacttggagaactgctggtttaatgagtcttaagtgcatctgactgttgaggag

SEQ ID NO: 285665 - DNA, 939 bp, Homo sapiens
gctgggcccaatgcttgattttgaacaaaactaattttggggggaaaaagggctacaaaaagctctggaaggagggagaatcacaagtttaagttatgtctatgcaaactatcataattagcatcagggctgagggaagactagaaactatgcagtttaatggtggttttgattggaaccctttaccctcatggcaatgtggaaaatggattattaggaaaaaagacttgtgggggtgtgtgtgcgcacaagtgctgcatggtgatcaccaaggccttgcaagtgacagactgcagacacgtgcttatgagcaacagactacttaaaccattctctctcttttcacttttaaaggagagttgcaggaggggaaatagacaaaaaacaaaaccctgagtcaaaataatgtgagtggactttaaaggtgacaaatcttctctagtgtgagattcggaaacttctggtgaggaggaagtatgagtttggtctggaaggcctgagccaggtgtgagtccagagagacatggggttagtatgtagagaaaccaggataaaaaaaaatttagtgctgcaggtttctgattccactaacacatctaaatatggcaaaagagcaagtgaatgtctcacaaggttttgatgtataatatggatttggttttgtttttatcggtacaaggaaaccatctctgtcaccagcttttatttctaaggaaaaggatttttgtgaaaacattttcaattcctgctggtggcctgatagataccatcctaaaagcttcctttatcagagaattccacaaaaagtcttgagaaaatgaacaatgaatcagaagattaatccaagatgtacagtggagtttgtctacagagacactgacatgacttctgaagccagggggcatgcgagcgctcccaggcacggtccaccaagtgcaa

SEQ ID NO: 285666 - DNA, 2120 bp, Homo sapiens
gctgggcccaatgcttgattttgaacaaaactaattttggggggaaaaagggctacaaaaagctctggaaggagggagaatcacaagtttaagttatgtctatgcaaactatcataattagcatcagggctgagggaagactagaaactatgcagtttaatggtggttttgattggaaccctttaccctcatggcaatgtggaaaatggattattaggaaaaaagacttgtgggggtgtgtgtgcgcacaagtgctgcatggtgatcaccaaggccttgcaagtgacagactgcagacacgtgcttatgagcaacagactacttaaaccattctctctcttttcacttttaaaggagagttgcaggaggggaaatagacaaaaaacaaaaccctgagtcaaaataatgtgagtggactttaaaggtgacaaatcttctctagtgtgagattcggaaacttctggtgaggaggaagtatgagtttggtctggaaggcctgagccaggtgtgagtccagagagacatggggttagtatgtagagaaaccaggataaaaaaaaatttagtgctgcaggtttgacttgaaagctgctagtgacagcaatgacctgggtagagagatgtttccttgaaaacggctaaaatttatcatacttggtcagactgcaaggtagatgaaggccagggaagcctcttctgaggataattctgcagcaaaaattttttctttagagttagaaggaaagagaaaaccccaaaccagtatgcagagatcattaatgtttatgcaaatgaatcactaaccaagaaaacaaggaaaataaaaggaacaaaatgaattttaatggacatgtgctttaagcatgccaacagacaacacaccactagagacacacatcaaaagcaatcacagtgctatgatcaaatgatgggtacatgtgaacacatccctcgcaaccccaccccccacgttgcttctctttagcgattagtccagagtgctttagtggctgggcacacccgagatacttaaatcaggaggtgaacatgaatgcaacgtgacaactagtagcacagaaaacacctgattggtattcaaagtgcacgaagcaatgctattttcaagttcattgagtctctgcgtcatcactcaaaacaataaaaatactttttcttctcatacaagccaattgtaattaaaattttgttatgacaagctacatttaaaaatctagataaaaataggcatgatagcaaatgctaagaacatcatagcactcttttcttgtgtgcttatgtggttccttttttggagggtcttctagatacaaaaagtgtcaaattgggtgtcagtcctgatgatacaaaatttaaacacacacacatatatatatgaaaacatcacatatatacatatagatcaatgaaacacaaaatgtaacttggagccacaaacacacattagagctccctaatgaccaaagacaaggcagaagtttttttgtctaaaatgaattttgatgtgttttaaggcagagacccaataatgatgcatactacccccagaacataagaagcttggcatctatctatatacccatctacagtcagaagtagatagatatgtacatagagataaggaaaaacaaacaagatgctatatgacgttatcctgacaaaagaaaaaaaaagacatgcatcatgaaataaaaagacaaatcagacttaactcatggagaacacatatcaaaacaggtttctgattccactaacacatctaaatatggcaaaagagcaagtgaatgtctcacaaggttttgatgtataatatggatttggttttgtttttatcggtacaaggaaaccatctctgtcaccagcttttatttctaaggaaaaggatttttgtgaaaacattttcaattcctgctggtggcctgatagataccatcctaaaagcttcctttatcagagaattccacaaaaagtcttgagaaaatgaacaatgaatcagaagattaatccaagatgtacagtggagtttgtctacagagacactgacatgacttctgaagccagggggcatgcgagcgctcccaggcacggtccaccaagtgcaa

SEQ ID NO: 285667 - DNA, 1881 bp, Homo sapiens
ttccgggttaagggaaagcgtgggtgtgagtaggagtcttcggaaaccctttttctttcttttcgccccgctgctgttcgggagatggacttctggagtccccgtcgtagctggtgttgtcccctctaccttcaggaaagaagggcagatggccctcttgcctactgaagccgaggaggggcgcgtatacagcgggctaagggcgctcaagagatccgagtggaagaaaaagcagcggcacagcactggaatgggcgggagtggcagaagagttgtgaaggctattggctagcaagggtggtgggcggggcgtagaccgagctacccagtttactggtcgatttcggatccagttttccagttatagccacgttggcacctcttgaacctctgtggccgttagcacggttttctgcccgcgtgcccgagaaaccaacggattagaaggacttttaaagatgtgtgaggaaagagctcaccgctgaagaaggctgctgcatcactgaacttcttatcactaacatagcgagattttagtttggacgaatttgaggttataggggagatagcgatggcagaagactaggtggaaatggcacatctaggttggctgcagtcgaaacggtttgagcgtggtcgctgtggctcatcgtcggcaccaattaacgaagcgatgacatctgcgttgttaggggtttcttaaactgagttggtagaaatgcgaagcgtcagggttcccgccggcttcgagcctttcttggcgtatttgtatcttgagctgatttctgcgtcagcccacatctcgctctgatccgcacgccccccgggttgttttgcagtagcagtctcagccctcttctcgtctcattcccaaatcgtaatttcagttcacagctttttatctataatagctttatcaactctttttccgatgctctgcaccagatctcttaaaatataaaattaccttgcaaggtattgtttggaatacacggtattttcatgaagacaactattaatagaaaaatcagagtccagaactatggttctccatttctggtatactggtttgcagaagccttacattaagatttcataaatgattgtttgctgttaagtgcaacaacatcacagtagagctacataaagattgaaaggagaatatttatcaagtggcaccagaatggactgattaaaatagaatggcctaattggaaagaatttcaggatcaccggtttctcctgcttcatggacaggccttcagtatttggcatcacctttacatggagcacaaagatgatgatgatgatgatgtgtcttttgccaaatggatgagcagcttctggggccacagctggagagaggaggatcagagaggactccgggaacgccaccgactgcaagccaccagtcacaggaaaacctccctgccctgcccacttcctgtgcttcccagaattccatcatctgactgccatcctagaaggcattctcatgaggaccaggaattccgatgccgatcgtctgaccgtcttcctagaaggcattctcatgaggaccaagaatttcgatgccgtagccacgtacgggattacagaaaatactcagaggatggggtcattcaaggaggccactgggaatcaaaaggaagattcccattccaaaattgagaaattttcagagtccttttgaacggcaactgtgctttagaaccaagcgttctgcctctttgggacctgaaagcagaaaggagagaaatgaaagagaatgcctgaggatggagataaaatcccgaaagaaagtagaggaagaaaggagctctaggaaagaagaacatggagaagcacacatggctccctgtttgaaaaagggctgaataa

SEQ ID NO: 285668 - DNA, 1130 bp, Homo sapiens
ttccgggttaagggaaagcgtgggtgtgagtaggagtcttcggaaaccctttttctttcttttcgccccgctgctgttcgggagatggacttctggagtccccgtcgtagctggtgttgtcccctctaccttcaggaaagaagggcagatggccctcttgcctactgaagccgaggaggggcgcgtatacagcgggctaagggcgctcaagagatccgagtggaagaaaaagcagcggcacagcactggaatgggcgggagtggcagaagagttgtgaaggctattggctagcaagggtggtgggcggggcgtagaccgagctacccagtttactggtcgatttcggatccagttttccagttatagccacgttggcacctcttgaacctctgtggccgttagcacggttttctgcccgcgtgcccgagaaaccaacggattagaaggacttttaaagatgtgtgaggaaagagctcaccgctgaagaaggctgctgcatcactgaacttcttatcactaacatagcgagattttagtttggacgaatttgaggttataggggagatagcgatggcagaagactaggtggaaatggcacatctaggttggctgcagtcgaaacggtttgagcgtggtcgctgtggctcatcgtcggcaccaattaacgaagcgatgacatctgcgttgttaggggtttcttaaactgagttggtagaaatgcgaagcgtcagggttcccgccggcttcgagcctttcttggcgtatttgtatcttgagctgatttctgcgtcagcccacatctcgctctgatccgcacgccccccgggttgttttgcagtagcagtctcagccctcttctcgtctcattcccaaatcgtaatttcagttcacagctttttatctataatagctttatcaactctttttccgatgctctgcaccagatctcttaaaatataaaattaccttgcaaggtattgtttggaatacacggtattttaatagaataaagaaaaatttgaaaatataatggaaggtatttaaagagccacccacatagcttcaccaacccttctcacacatcaactcataaatcatcttaaataaaagtcattggtatgactcttga

SEQ ID NO: 285669 - DNA, 734 bp, Homo sapiens
atcggagaccattttaaaaagaccagtttcattttgtcttttgggagagatcctgggtttcattgtcagccctgttgggtgatatttccctctgtcgcatttagggacaggccttcagtatttggcatcacctttacatggagcacaaagatgatgatgatgatgatgtgtcttttgccaaatggatgagcagcttctggggccacagctggagagaggaggatcagagaggactccgggaacgccaccgactgcaagccaccagtcacaggaaaacctccctgccctgcccacttcctgtgcttcccagaattccatcatctgactgccatcctagaaggcattctcatgaggaccaggaattccgatgccgatcgtctgaccgtcttcctagaaggcattctcatgaggaccaagaatttcgatgccgtagccacgtacgggattacagaaaatactcagaggatggggtcattcaaggaggccactgggaatcaaaaggaagattcccattccaaaattgagaaattttcagagtccttttgaacggcaactgtgctttagaaccaagcgttctgcctctttgggacctgaaagcagaaaggagagaaatgaaagagaatgcctgaggatggagataaaatcccgaaagaaagtagaggaagaaaggagctctaggaaagaagaacatggagaagcacacatggctccctgtttgaaaaagggctgaataa

SEQ ID NO: 285670 - DNA, 678 bp, Homo sapiens
atcggagaccattttaaaaagaccagtttcattttgtcttttgggagagatcctgggtttcattgtcagccctgttgggtgatatttccctctgtcgcatttagggacaggccttcagtatttggcatcacctttacatggagcacaaagatgatgatgatgatgatgtgtcttttgccaaatggatgagcagcttctggggccacagctggagagaggaggatcagagaggactccgggaacgccaccgactgcaagccaccagtcacaggaaaacctccctgccctgcccacttcctgtgcttcccagaattccatcatctgactgccatcctagaaggcattctcattgaggaccaagaatttcgatgccgtagccacgtacgggattacagaaaatactcagaggatggggtcattcaaggaggccactgggaatcaaaaggaagattcccattccaaaattgagaaattttcagagtccttttgaacggcaactgtgctttagaaccaagcgttctgcctctttgggacctgaaagcagaaaggagagaaatgaaagagaatgcctgaggatggagataaaatcccgaaagaaagtagaggaagaaaggagctctaggaaagaagaacatggagaagcacacatggctccctgtttgaaaaagggctgaataa

SEQ ID NO: 285671 - DNA, 1943 bp, Homo sapiens
ttccgggttaagggaaagcgtgggtgtgagtaggagtcttcggaaaccctttttctttcttttcgccccgctgctgttcgggagatggacttctggagtccccgtcgtagctggtgttgtcccctctaccttcaggaaagaagggcagatggccctcttgcctactgaagccgaggaggggcgcgtatacagcgggctaagggcgctcaagagatccgagtggaagaaaaagcagcggcacagcactggaatgggcgggagtggcagaagagttgtgaaggctattggctagcaagggtggtgggcggggcgtagaccgagctacccagtttactggtcgatttcggatccagttttccagttatagccacgttggcacctcttgaacctctgtggccgttagcacggttttctgcccgcgtgcccgagaaaccaacggattagaaggacttttaaagatgtgtgaggaaagagctcaccgctgaagaaggctgctgcatcactgaacttcttatcactaacatagcgagattttagtttggacgaatttgaggttataggggagatagcgatggcagaagactaggtggaaatggcacatctaggttggctgcagtcgaaacggtttgagcgtggtcgctgtggctcatcgtcggcaccaattaacgaagcgatgacatctgcgttgttaggggtttcttaaactgagttggtagaaatgcgaagcgtcagggttcccgccggcttcgagcctttcttggcgtatttgtatcttgagctgatttctgcgtcagcccacatctcgctctgatccgcacgccccccgggttgttttgcagtagcagtctcagccctcttctcgtctcattcccaaatcgtaatttcagttcacagctttttatctataatagctttatcaactctttttccgatgctctgcaccagatctcttaaaatataaaattaccttgcaaggtattgtttggaatacacggtattttcatgaagacaactattaatagaaaaatcagagtccagaactatggttctccatttctggtatactggtttgcagaagccttacattaagatttcataaatgattgtttgctgttaagtgcaacaacatcacagtagagctacataaagattgaaaggagaatatttatcaagtggcaccagaatggactgattaaaatagaatggcctaattggaaagaatttcaggatcaccggtttctcctgcttcatgtttactcaaactcctagtagtaaagtggtaaattcagcgtatatgattcacattatacctgggacaggccttcagtatttggcatcacctttacatggagcacaaagatgatgatgatgatgatgtgtcttttgccaaatggatgagcagcttctggggccacagctggagagaggaggatcagagaggactccgggaacgccaccgactgcaagccaccagtcacaggaaaacctccctgccctgcccacttcctgtgcttcccagaattccatcatctgactgccatcctagaaggcattctcatgaggaccaggaattccgatgccgatcgtctgaccgtcttcctagaaggcattctcatgaggaccaagaatttcgatgccgtagccacgtacgggattacagaaaatactcagaggatggggtcattcaaggaggccactgggaatcaaaaggaagattcccattccaaaattgagaaattttcagagtccttttgaacggcaactgtgctttagaaccaagcgttctgcctctttgggacctgaaagcagaaaggagagaaatgaaagagaatgcctgaggatggagataaaatcccgaaagaaagtagaggaagaaaggagctctaggaaagaagaacatggagaagcacacatggctccctgtttgaaaaagggctgaataa

SEQ ID NO: 285672 - DNA, 2090 bp, Homo sapiens
ggccgctttgggggccgcggtctctccgcagctcgcgggtcacatggcccgcctgagcaaggggagccctgcgcctgagctgcgaggcgggaggaggtgaggctccggcgcacacccaaaccgcgctgcgcccgctccttccgggccccggagatggcgcctccaccgggatgagctagccagcctgggcaataccagaggcggccctcggcgcgcgcaggggaccgagctggtcgccccaaccgggtttgatttctgatgactctggcctgagttccaggatggttttttcttgggaccagacatgaacaaaagttgacctcatgagcacttcaacctctccagctgccatgctcctccggaggctgcggcgactgtcctggggcagcactgctgtccagctcttcatcctaacagtggtgacgtttggcctgctggcccccctggcctgtcaccgacttctacactcttacttctatctgcgccattggcatctgaaccaaatgagccaagagttcctgcagcaaagcttgaaagagggtgaggctgccctccactattttgaggagcttccctctgccaatggctcagtgcccattgtctggcaggccaccccccggccctggctggtgatcaccatcatcactgtggacaggcagcctggcttccactacgtcctgcaggttgtgtcccagttccaccggcttcttcagcaatgtggcccccagtgcgaggggcaccaactcttcctgtgcaacgtggagcgtagtgtgagccattttgatgccaagttgctctccaagtatgtccctgtggccaatcgctatgagggcactgaggatgattatggtgatgacccttcgaccaactcgtttgagaaagagaagcaggactatgtctattgcctggagtcatccctgcagacctacaacccagactacgtcctgatggtagaagacgatgctgtaccagaagagcagatcttcccagtcttggagcaccttctgcgggctcgcttctctgagccacatctcagagatgccctttatctcaagctgtatcaccccgagaggctccagcactacatcaatccagagcccatgcggatcctggaatgggttggtgtaggcatgttgctggggcccttactaacctggatatacatgaggtttgccagccgcccagggtttagctggcctgtaatgctcttcttctccctgtatagcatgggtctggtggagctggtgggtcggcactatttcctggaactgcggcggctgagtccttccctgtacagtgtggttcctgcctctcagtgttgcaccccagccatgctcttcccggcacctgcggcccgccggaccctcacctacctgtcccaagtgtactgccacaagggctttggcaaggacatggcactgtactcgctgttgagggccaagggagagagggcctatgtagtggagccgaacctcgtgaaacacatcgggctcttctccagtctccggtacaactttcatcccagtctcctctagggtgccaagagatgcctttctgaagttggccacttcttgaagattcaaatatttatctctttatttagacatggttgcctgcaggtatttcactgtttactgttgttagagatataggcactggggcagctgaggaacctcaatatgttaagagccttggctttggtagcctcctggcaggagcagcagtttgccacaggtccggacctctccctccacacagccacactgcctcatgcagtctgacccacccagtgagggtgcatttgaacactgattatattctccatttgtttttaagctctgctttgtgttagagcttgtgactgccaaaaattttgtgcacagtgatatgactgttttaggatcttaagggtagaattttgtgaaaggtgagatcctttggaattgagttctttctcattgggtatgaaaatggatgtatgtttagaatatatgcccaacgaggcaggaccatgtggatagattccatttgtttccttgacctgatgtaataaaaactgataaaagccgtgcagtgcccggcatcttgga

SEQ ID NO: 285673 - DNA, 2419 bp, Homo sapiens
ggccgctttgggggccgcggtctctccgcagctcgcgggtcacatggcccgcctgagcaaggggagccctgcgcctgagctgcgaggcgggaggaggtgaggctccggcgcacacccaaaccgcgctgcgcccgctccttccgggccccggagatggcgcctccaccgggatgagctagccagcctgggcaataccagaggcggccctcggcgcgcgcaggggaccgagctggtcgccccaaccgggtttgatttctgatgactctggcctgagttccaggatggttttttcttgggaccagacatgaacaaaagttgacctcatgagcacttcaacctctccagctgccatgctcctccggaggctgcggcgactgtcctggggcagcactgctgtccagctcttcatcctaacagtggtgacgtttggcctgctggcccccctggcctgtcaccgacttctacactcttacttctatctgcgccattggcatctgaaccaaatgagccaagagttcctgcagcaaagcttgaaagagggtgaggctgccctccactattttgaggagcttccctctgccaatggctcagtgcccattgtctggcaggccaccccccggccctggctggtgatcaccatcatcactgtggacaggcagcctggcttccactacgtcctgcaggttgtgtcccagttccaccggcttcttcagcaatgtggcccccagtgcgaggggcaccaactcttcctgtgcaacgtggagcgtagtgtgagccattttgatgccaagttgctctccaagtatgtccctgtggccaatcgctatgagggcactgaggatgattatggtgatgacccttcgaccaactcgtttgagaaagagaagcaggactatgtctattgcctggagtcatccctgcagacctacaacccagactacgtcctgatggtagaagacgatgctgtaccagaagagcagatcttcccagtcttggagcaccttctgcgggctcgcttctctgagccacatctcagagatgccctttatctcaagctgtatcaccccgagaggctccagcactacatcaatccagagcccatgcggatcctggaatgggttggtgtaggcatgttgctggggcccttactaacctggatatacatgaggtttgccagccgcccagggtttagctggcctgtaatgctcttcttctccctgtatagcatgggtctggtggagctggtgggtcggcactatttcctggaactgcggcggctgagtccttccctgtacagtgtggttcctgcctctcagtgttgcaccccagccatgctcttcccggcacctgcggcccgccggaccctcacctacctgtcccaagtgtactgccacaagggctttggcaaggacatggcactgtactcgctgttgagggccaagggagagagggcctatgtagtggagccgaacctcgtgaaacacatcgggctcttctccagtctccggtacaactttcatcccagtctcctctagggtgccaagagatgcctttctgaagttggccacttcttgaagattcaaatatttatctctttatttagacatggttgcctgcaggtatttcactgtttactgttgttagagatataggcactggggcagctgaggaacctcaatatgttaagagccttggctttggtagcctcctggcaggagcagcagtttgccacaggtccggacctctccctccacacagccacactgcctcatgcagtctgacccacccagtgagggtgcatttgaacactgattatattctccatttgtttttaagctctgctttgtgttagagcttgtgactgccaaaaattttgtgcacagtgatatgactgttttaggatcttaagggtagaattttgtgaaaggtgagatcctttggaattgagttctttctcattgggtatgaaaatggatgtatgtttagaatatatgcccaacgaggcaggaccatgtggatagattccatttgtttccttgacctgatgtaataaaaactgataaaagccgtgcagtgcccggcatcttggaggcaggtgatctggcttttctgttacctgggattttcttttcctatatatctgtagtgcactgataattgatattgttagtgagaactttaaggcacgacaagatctggaagagcttgtgaaccatcaaagtcagattgcttatgttgagtagtgatttaacattgaacatttctgtactactctgactctttgaaaattggacatttcagaatgatacaatataggggagctctttacaagtagcatatcatttttcctgactttcctggctgactgcttaccttcatttctttttcttctaggtagcatgatgttatagaaaaaaaa

SEQ ID NO: 285674 - DNA, 2145 bp, Homo sapiens
ggccgctttgggggccgcggtctctccgcagctcgcgggtcacatggcccgcctgagcaaggggagccctgcgcctgagctgcgaggcgggaggaggtgaggctccggcgcacacccaaaccgcgctgcgcccgctccttccgggccccggagatggcgcctccaccgggatgagctagccagcctgggcaataccagaggcggccctcggcgcgcgcaggggaccgagctggtcgccccaaccggcaaagcagtcatctaatcttgaatgaaggatctgatcccagctcctgtgtcctaggtttgatttctgatgactctggcctgagttccaggatggttttttcttgggaccagacatgaacaaaagttgacctcatgagcacttcaacctctccagctgccatgctcctccggaggctgcggcgactgtcctggggcagcactgctgtccagctcttcatcctaacagtggtgacgtttggcctgctggcccccctggcctgtcaccgacttctacactcttacttctatctgcgccattggcatctgaaccaaatgagccaagagttcctgcagcaaagcttgaaagagggtgaggctgccctccactattttgaggagcttccctctgccaatggctcagtgcccattgtctggcaggccaccccccggccctggctggtgatcaccatcatcactgtggacaggcagcctggcttccactacgtcctgcaggttgtgtcccagttccaccggcttcttcagcaatgtggcccccagtgcgaggggcaccaactcttcctgtgcaacgtggagcgtagtgtgagccattttgatgccaagttgctctccaagtatgtccctgtggccaatcgctatgagggcactgaggatgattatggtgatgacccttcgaccaactcgtttgagaaagagaagcaggactatgtctattgcctggagtcatccctgcagacctacaacccagactacgtcctgatggtagaagacgatgctgtaccagaagagcagatcttcccagtcttggagcaccttctgcgggctcgcttctctgagccacatctcagagatgccctttatctcaagctgtatcaccccgagaggctccagcactacatcaatccagagcccatgcggatcctggaatgggttggtgtaggcatgttgctggggcccttactaacctggatatacatgaggtttgccagccgcccagggtttagctggcctgtaatgctcttcttctccctgtatagcatgggtctggtggagctggtgggtcggcactatttcctggaactgcggcggctgagtccttccctgtacagtgtggttcctgcctctcagtgttgcaccccagccatgctcttcccggcacctgcggcccgccggaccctcacctacctgtcccaagtgtactgccacaagggctttggcaaggacatggcactgtactcgctgttgagggccaagggagagagggcctatgtagtggagccgaacctcgtgaaacacatcgggctcttctccagtctccggtacaactttcatcccagtctcctctagggtgccaagagatgcctttctgaagttggccacttcttgaagattcaaatatttatctctttatttagacatggttgcctgcaggtatttcactgtttactgttgttagagatataggcactggggcagctgaggaacctcaatatgttaagagccttggctttggtagcctcctggcaggagcagcagtttgccacaggtccggacctctccctccacacagccacactgcctcatgcagtctgacccacccagtgagggtgcatttgaacactgattatattctccatttgtttttaagctctgctttgtgttagagcttgtgactgccaaaaattttgtgcacagtgatatgactgttttaggatcttaagggtagaattttgtgaaaggtgagatcctttggaattgagttctttctcattgggtatgaaaatggatgtatgtttagaatatatgcccaacgaggcaggaccatgtggatagattccatttgtttccttgacctgatgtaataaaaactgataaaagccgtgcagtgcccggcatcttgga

SEQ ID NO: 285675 - DNA, 920 bp, Homo sapiens
tgcggccgctccaacatcagaaaggcatctcttggcaccctagaggagactgggatgaaagttggccacttcttgaagattcaaatatttatctctttatttagacatggttgcctgcaggtatttcactgtttactgttgttagagatataggcactggggcagctgaggaacctcaatatgttaagagccttggctttggtagcctcctggcaggagcagcagtttgccacaggtccggacctctccctccacacagccacactgcctcatgcagtctgacccacccagtgagggtgcatttgaacactgattatattctccatttgtttttaagctctgctttgtgttagagcttgtgactgccaaaaattttgtgcacagtgatatgactgttttaggatcttaagggtagaattttgtgaaaggtgagatcctttggaattgagttctttctcattgggtatgaaaatggatgtatgtttagaatatatgcccaacgaggcaggaccatgtggatagattccatttgtttccttgacctgatgtaataaaaactgataaaagccgtgcagtgcccggcatcttggaggcaggtgatctggcttttctgttacctgggattttcttttcctatatatctgtagtgcactgataattgatattgttagtgagaactttaaggcacgacaagatctggaagagcttgtgaaccatcaaagtcagattgcttatgttgagtagtgatttaacattgaacatttctgtactactctgactctttgaaaattggacatttcagaatgatacaatataggggagctctttacaagtagcatatcatttttcctgactttcctggctgactgcttaccttcatttctttttcttctaggtagcatgatgttatagaaaaaaaa

SEQ ID NO: 285676 - DNA, 630 bp, Homo sapiens
cagcttgtggctgatcagctgggagtccatcctgttccttttgacttcaccctgccatgctgctccacagcagggaagcccaggcggctgtcacattggatggaagaggaggccttgtattctggaagggagccatagacttccttttcgaaagaggcctgaaggccacctggacgagcctcccccagtaccagaacccctcaatgacattgccaagatacaattgttcagcttctgcttcaatattttcagcaacgggaactccctacttggatgcatctttgcaagccaggagaagaaggggctgcaacagcccgagcccctaggaatgcccaggaagctgaggtgagctcaacttgctttgaggatgaagttggtgcatctgcctcacctgcactcctcgccttccagcagcttgcggtaggtggcgatctccacgtccagggccagcttgatgttcatcagctcctggtactcacgcaggagccgagccatgtcctgcttggccttctgcagggcctcctcaaggtccaccagcttggcccgtgcatccttgagagccagttctccccgctgctctgcatcagcaatggccgtttgcaagctggaacactgtaaggacaggaggaa

SEQ ID NO: 285677 - DNA, 387 bp, Homo sapiens
ttttttagacagagtctcgatctgtcacccaggctgtaagtgaaactcagtcttcaaaaacaaaataaaaacaaaaacaaaaacaaaaaaaacaaacaaaaaaataaatacttaaactgttaactatcacataatgattgaggtagggaaattgaggaacaagaggcaacacttttccttttatttcataatgttcagtattgtttaaaaaaatgcatgtattacttctgtaatttaaatattttttaacacccaggataggggtgagagcaggggtgaagacaaaccaagaggtgctaggcttaatttctaaggaaatggatgtaaaaaatcatggaaaaattaactttttctaacttagtcatacatacccccaataatattttc

SEQ ID NO: 285678 - DNA, 1215 bp, Homo sapiens
gtgttcatgggcctcattaagctctgccttccttctgctttttggagcctggcctttggttggccttgaatgaagagtggggccccaaaagtaccactgtcagcactctccagcatcatctggctgtctggcaccatcaaagaattgcatttctgacccaagaagagcttatgggtggatgggggtgggatggaagctggggagaggattgatgccagccagctgcctcacagggtgctggaaacacgtggccatgccattagcatcctgttcggcttctggacgagtttcatctgtgacacctacatagtcctcgcttggatcagcaagataaaaggcagccctgatgttagtgcctcctctgatgagccatacgccagaatccagcagagcagaaggcaatgccacgcagaagaggaccaaagtcaggtgccagaagcaggctgacctggaaaggtggaggaaaagaaggcagaagggagagatgaagcccaagaacctgagtatttttctcaggcaagactcaggactgctctggacattcagaagctgagtgtgcaagtgtgctgtgtagttcaaggccaccaccactgaagaggccaaggacaccttagtaggaattctaacctggcttccagggagaggtgcttccaaattggccctgtaggcaaattcacttttttcaccctctaagcgagtaagtgcttgttcccaatttccatggtttagtcttcagtttcagtctttggtctcctctggtctatcagctcccatctctctcccagtctttttctttattctgtgacacctgttgaatgaggcacatagggtttgtagtcactgtagtgttccttgtggttgtgaggtaataggctaatattatcactttctcagaaagtcttcaaaattatcatgaggaggtgatgcattcatctgctgggaggtgtctgtgtggtcagataagatgatggctacattccattcctatcctgtcattcaatcattcttcctccagggagccactgagggacgtgatagtccaaagcactcagctaaaacggaattgcaaacatggtacccacaactttggtttcttatcatccatttgtatatctgcatgtagtctgtctctgatttagggtttaggttcctctgtatttttttttcttttcctgccctttgagagtttaataaaagccagaagcatcttgtaat

SEQ ID NO: 285679 - DNA, 496 bp, Homo sapiens
catgggtaatttatccagaccatggcccttagaatggattcagtgcactgttatagaaataagtcctaaaccaactagtatcataacctaatgccttagggtagtaaagtacctcttatctcatctggttgactggttaattaggtttgatttggcttgttttttaaaatcatttagaatgaataattttgagggtttgattacatctgtaaatggctaagttttgctgtattctaatataagaatagggctgataaaatattatctttgaaatgtattacacttaaaagattccagctactttttattgagttaaactattttttgtatattagatacaaatttcagtcatttatttccaattgagtatacttaagattttacagttgtggtttgccactggtcataggtgctttgatgatatatagtaagattagacctttaataaaattgtcaaatatataacatgaatattataggtattataaaaaagttg

SEQ ID NO: 285680 - DNA, 2724 bp, Homo sapiens
ggccgtgcaggggcgggctccgagcgtggggtgggcgcttgcgcactgccgctgcggctgttgctgcggagccaggaggggaagcgatggctgggcccgcgtggatctccaaggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattctaaaccattttacacttaagttaaaatagtttctcttcagctgtaaataacaggatacagaattaacaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaatattctttccaagagcttttaatgaagcagagagctagtacttcattttcactggatacattttcagcatcatgagttgtcacagcctctgagcccctgatctgaagccagaagggctgagtgtattgtaaacttattcttgcatgttgctgtctgggaatggaccacactacagcaggtagttctgggggcgatactgccgaaaggcccgaacacatgtattttggctgcaattgaggaacttgggatgctattaattttgtatttcagcaactgccccttctcctatcccaaagcaccaattactgccctctgcctcagcagtaccagtataagatgacattccaaagactggaggcaactcagcctgagttaattcacaaaattatgccatgctggggcttgagcttgagcttgggcttaggcttgggctcagcttttgaccctcaggcatctcctttcccttcctgtcttcctctcccttctcctctgctgcagcatgattttcttaatcttcagacactcactattttcatgaacagttaccctctgtccccacaaccaaagacaactcatggcctcctttggcccttgtgtaacattgcaaacctgtggctttgcaaaatgtacccaggtcacaaggggatttttttttttttagcaatgatatccctgtctgggtcactttttaagcttgtaaccgcccccccagacttataatcttaaatgtattttcctttgtttaagctgctgcttcctctgtttcattggattgtgccagttatcagtggctcttgggttcaaagtaataaagaattccaaaactga

SEQ ID NO: 285681 - DNA, 2587 bp, Homo sapiens
aggcgacagagcgggactctatctcaaaaacgaagttgaaaaaagtttgttcatcattgcagtatgaatgccagtttcctttaagtctctccagctcactgtgctctgtgatgtggcatctaggcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattctaaaccattttacacttaagttaaaatagtttctcttcagctgtaaataacaggatacagaattaacaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaatattctttccaagagcttttaatgaagcagagagctagtacttcattttcactggatacattttcagcatcatgagttgtcacagcctctgagcccctgatctgaagccagaagggctgagtgtattgtaaacttattcttgcatgttgctgtctgggaatggaccacactacagcaggtagttctgggggcgatactgccgaaaggcccgaacacatgtattttggctgcaattgaggaacttgggatgctattaattttgtatttcagcaactgccccttctcctatcccaaagcaccaattactgccctctgcctcagcagtaccagtataagatgacattccaaagactggaggcaactcagcctgagttaattcacaaaattatgccatgctggggcttgagcttgagcttgggcttaggcttgggctcagcttttgaccctcaggcatctcctttcccttcctgtcttcctctcccttctcctctgctgcagcatgattttcttaatcttcagacactcactattttcatgaacagttaccctctgtccccacaaccaaagacaactcatggcctcctttggcccttgtgtaacattgcaaacctgtggctttgcaaaatgtacccaggtcacaaggggatttttttttttttagcaatgatatccctgtctgggtcactttttaagcttgtaaccgcccccccagacttataatcttaaatgtattttcctttgtttaagctgctgcttcctctgtttcattggattgtgccagttatcagtggctcttgggttcaaagtaataaagaattccaaaactga

SEQ ID NO: 285682 - DNA, 938 bp, Homo sapiens
ggccgtgcaggggcgggctccgagcgtggggtgggcgcttgcgcactgccgctgcggctgttgctgcggagccaggaggggaagcgatggctgggcccgcgtggatctccaaggtctctcggctgctgggggcattccacaacccaaaacaggtgaccagaggttttactggtggtatcaactttgccaagcttatgtagattactcttagatttaagcagacagttttatagaggaactaagaaaaaaatggaagctctcttgataaaaagtctgattttccctgagtaccaaaacagacctcagtaatattttggaaatgtgtctgaaaatgttttgcaagactgaagaagttgcatgagaagctttccaggatcacaatggaaaggaaaggaaaacacttgccttcatgagaaaccgtctaaattttagttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgtccacttgacggcgtgcagagtattaagctcatcacccgagcgggaagcaaagcattgggagattggcttaagatggccggaaacccggggaccgcggggggcaaagacaatatgc

SEQ ID NO: 285683 - DNA, 2979 bp, Homo sapiens
ggccgtgcaggggcgggctccgagcgtggggtgggcgcttgcgcactgccgctgcggctgttgctgcggagccaggaggggaagcgatggctgggcccgcgtggatctccaaggtctctcggctgctgggggcattccacaacccaaaacaggtgaccagaggttttactggtggtatcaactttgccaagcttatgtagattactcttagatttaagcagacagttttatagaggaactaagaaaaaaatggaagctctcttgataaaaagtctgattttccctgagtaccaaaacagacctcagtaatattttggaaatgtgtctgaaaatgttttgcaagactgaagaagttgcatgagaagctttccaggatcacaatggaaaggaaaggaaaacacttgccttcatgagaaaccgtctaaattttagttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattctaaaccattttacacttaagttaaaatagtttctcttcagctgtaaataacaggatacagaattaacaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaatattctttccaagagcttttaatgaagcagagagctagtacttcattttcactggatacattttcagcatcatgagttgtcacagcctctgagcccctgatctgaagccagaagggctgagtgtattgtaaacttattcttgcatgttgctgtctgggaatggaccacactacagcaggtagttctgggggcgatactgccgaaaggcccgaacacatgtattttggctgcaattgaggaacttgggatgctattaattttgtatttcagcaactgccccttctcctatcccaaagcaccaattactgccctctgcctcagcagtaccagtataagatgacattccaaagactggaggcaactcagcctgagttaattcacaaaattatgccatgctggggcttgagcttgagcttgggcttaggcttgggctcagcttttgaccctcaggcatctcctttcccttcctgtcttcctctcccttctcctctgctgcagcatgattttcttaatcttcagacactcactattttcatgaacagttaccctctgtccccacaaccaaagacaactcatggcctcctttggcccttgtgtaacattgcaaacctgtggctttgcaaaatgtacccaggtcacaaggggatttttttttttttagcaatgatatccctgtctgggtcactttttaagcttgtaaccgcccccccagacttataatcttaaatgtattttcctttgtttaagctgctgcttcctctgtttcattggattgtgccagttatcagtggctcttgggttcaaagtaataaagaattccaaaactga

SEQ ID NO: 285684 - DNA, 2955 bp, Homo sapiens
ggccgtgcaggggcgggctccgagcgtggggtgggcgcttgcgcactgccgctgcggctgttgctgcggagccaggaggggaagcgatggctgggcccgcgtggatctccaaggtctctcggctgctgggggcattccacaacccaaaacagatcaactttgccaagcttatgtagattactcttagatttaagcagacagttttatagaggaactaagaaaaaaatggaagctctcttgataaaaagtctgattttccctgagtaccaaaacagacctcagtaatattttggaaatgtgtctgaaaatgttttgcaagactgaagaagttgcatgagaagctttccaggatcacaatggaaaggaaaggaaaacacttgccttcatgagaaaccgtctaaattttagttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattctaaaccattttacacttaagttaaaatagtttctcttcagctgtaaataacaggatacagaattaacaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaatattctttccaagagcttttaatgaagcagagagctagtacttcattttcactggatacattttcagcatcatgagttgtcacagcctctgagcccctgatctgaagccagaagggctgagtgtattgtaaacttattcttgcatgttgctgtctgggaatggaccacactacagcaggtagttctgggggcgatactgccgaaaggcccgaacacatgtattttggctgcaattgaggaacttgggatgctattaattttgtatttcagcaactgccccttctcctatcccaaagcaccaattactgccctctgcctcagcagtaccagtataagatgacattccaaagactggaggcaactcagcctgagttaattcacaaaattatgccatgctggggcttgagcttgagcttgggcttaggcttgggctcagcttttgaccctcaggcatctcctttcccttcctgtcttcctctcccttctcctctgctgcagcatgattttcttaatcttcagacactcactattttcatgaacagttaccctctgtccccacaaccaaagacaactcatggcctcctttggcccttgtgtaacattgcaaacctgtggctttgcaaaatgtacccaggtcacaaggggatttttttttttttagcaatgatatccctgtctgggtcactttttaagcttgtaaccgcccccccagacttataatcttaaatgtattttcctttgtttaagctgctgcttcctctgtttcattggattgtgccagttatcagtggctcttgggttcaaagtaataaagaattccaaaactga

SEQ ID NO: 285685 - DNA, 2573 bp, Homo sapiens
cattccacaacccacagcaggactggttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattctaaaccattttacacttaagttaaaatagtttctcttcagctgtaaataacaggatacagaattaacaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaatattctttccaagagcttttaatgaagcagagagctagtacttcattttcactggatacattttcagcatcatgagttgtcacagcctctgagcccctgatctgaagccagaagggctgagtgtattgtaaacttattcttgcatgttgctgtctgggaatggaccacactacagcaggtagttctgggggcgatactgccgaaaggcccgaacacatgtattttggctgcaattgaggaacttgggatgctattaattttgtatttcagcaactgccccttctcctatcccaaagcaccaattactgccctctgcctcagcagtaccagtataagatgacattccaaagactggaggcaactcagcctgagttaattcacaaaattatgccatgctggggcttgagcttgagcttgggcttaggcttgggctcagcttttgaccctcaggcatctcctttcccttcctgtcttcctctcccttctcctctgctgcagcatgattttcttaatcttcagacactcactattttcatgaacagttaccctctgtccccacaaccaaagacaactcatggcctcctttggcccttgtgtaacattgcaaacctgtggctttgcaaaatgtacccaggtcacaaggggatttttttttttttagcaatgatatccctgtctgggtcactttttaagcttgtaaccgcccccccagacttataatcttaaatgtattttcctttgtttaagctgctgcttcctctgtttcattggattgtgccagttatcagtggctcttgggttcaaagtaataaagaattccaaaactga

SEQ ID NO: 285686 - DNA, 2511 bp, Homo sapiens
  misc_feature (1431)..(1431): n is a, c, g, or t
ggccgtgcaggggcgggctccgagcgtggggtgggcgcttgcgcactgccgctgcggctgttgctgcggagccaggaggggaagcgatggctgggcccgcgtggatctccaaggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaggtagacacttaataaataaaacagcacttggacaaagttctttgaanacgaccggtaccgaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaatattctttccaagagcttttaatgaagcagagagctagtacttcattttcactggatacattttcagcatcatgagttgtcacagcctctgagcccctgatctgaagccagaagggctgagtgtattgtaaacttattcttgcatgttgctgtctgggaatggaccacactacagcaggtagttctgggggcgatactgccgaaaggcccgaacacatgtattttggctgcaattgaggaacttgggatgctattaattttgtatttcagcaactgccccttctcctatcccaaagcaccaattactgccctctgcctcagcagtaccagtataagatgacattccaaagactggaggcaactcagcctgagttaattcacaaaattatgccatgctggggcttgagcttgagcttgggcttaggcttgggctcagcttttgaccctcaggcatctcctttcccttcctgtcttcctctcccttctcctctgctgcagcatgattttcttaatcttcagacactcactattttcatgaacagttaccctctgtccccacaaccaaagacaactcatggcctcctttggcccttgtgtaacattgcaaacctgtggctttgcaaaatgtacccaggtcacaaggggatttttttttttttagcaatgatatccctgtctgggtcactttttaagcttgtaaccgcccccccagacttataatcttaaatgtattttcctttgtttaagctgctgcttcctctgtttcattggattgtgccagttatcagtggctcttgggttcaaagtaataaagaattccaaaactga

SEQ ID NO: 285687 - DNA, 2570 bp, Homo sapiens
ggccgtgcaggggcgggctccgagcgtggggtgggcgcttgcgcactgccgctgcggctgttgctgcggagccaggaggggaagcgatggctgggcccgcgtggatctccaaggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattctaaaccattttacacttaagttaaaatagtttctcttcagctgtaaataacaggatacagaattaacaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaatattctttccaagagcttttaatgaagcagagagctagtacttcattttcactggatacattttcagcatcatgagttgtcacagcctctgagcccctgatctgaagccagaagggctgagtgtattgtaaacttattcttgcatgttgctgtctgggaatggaccacactacagcaggtagttctgggggcgatactgccgaaaggcccgaacacatgtattttggctgcaattgaggaacttgggatgctattaattttgtatttcagcaactgccccttctcctatcccaaagcaccaattactgccctctgcctcagcagtaccagtataagatgacattccaaagactggaggcaactcagcctgagttaattcacaaaattatgccatgctggggcttgagcttgagcttgggcttaggcttgggctcagcttttgaccctcaggcatctcctttcccttcctgtcttcctctcccttctcctctgctgcagcatgattttcttaatcttcagacactcactattttcatgaacagttaccctctgtccccacaaccaaagacaactcatggcctcctttggcccttgtgtaacattgcaaacctgtggctttgcaaaatgtacccaggtcacagaggccaaaggaggccatgagttgtcttgtcgac

SEQ ID NO: 285688 - DNA, 1670 bp, Homo sapiens
ccacgcgtcggacccacgcgtcgtgtttgctacaattaaggacggaaagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattctaaaccattttacacttaagttaaaatagtttctcttcagctgtaaataacaggatacagaattaacaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaatattctttccaagagcttttaatgaagcagagagctagtacttcattttcactggatacattttcagcatcatgagttgtcacagcctctgagcccctgatctgaagccagaagggctgagtgtattgtaaacttattcttgcatgttgctgtctgggaatggaccacactacagcaggtagttctgggggcgatactgccgaaaggcccgaacacatgtattttggctgcaattgaggaacttgggatgctattaattttgtatttcagcaactgccccttctcctatcccaaagcaccaattactgccctctgcctcagcagtaccagtataagatgacattccaaagactggaggcaactcagcctgagttaattcacaaaattatgccatgctggggcttgagcttgagcttgggcttaggcttgggctcagcttttgaccctcaggcatctcctttcccttcctgtcttcctctcccttctcctctgctgcagcatgattttcttaatcttcagacactcactattttcatgaacagttaccctctgtccccacaaccaaagacaactcatggcctcctttggcccttgtgtaacattgcaaacctgtggctttgcaaaatgtacccaggtcacaaggggatttttttttttttagcaatgatatccctgtctgggtcactttttaagcttgtaaccgcccccccagacttataatcttaaatgtattttcctttgtttaagctgctgcttcctctgtttcattggattgtgccagttatcagtggctcttgggttcaaagtaataaagaattccaaaactga

SEQ ID NO: 285689 - DNA, 1886 bp, Homo sapiens
ttggtaagaagtgggctagggcattattaatcttagggcgaaagcctataatcactgcgccgctcataaggggatggccatggctaggtttatagatagttgggtggttggtgtaaataagtgaggcaggagtccgaggaggttagttgtggcaataaaaatgattaaggatactagtataagagatcaggttcgtcctttagtgttgtgtatggttatcatttgttttgaggctgcgtgttttgctacaattaaggacggaaagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattctaaaccattttacacttaagttaaaatagtttctcttcagctgtaaataacaggatacagaattaacaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaatattctttccaagagcttttaatgaagcagagagctagtacttcattttcactggatacattttcagcatcatgagttgtcacagcctctgagcccctgatctgaagccagaagggctgagtgtattgtaaacttattcttgcatgttgctgtctgggaatggaccacactacagcaggtagttctgggggcgatactgccgaaaggcccgaacacatgtattttggctgcaattgaggaacttgggatgctattaattttgtatttcagcaactgccccttctcctatcccaaagcaccaattactgccctctgcctcagcagtaccagtataagatgacattccaaagactggaggcaactcagcctgagttaattcacaaaattatgccatgctggggcttgagcttgagcttgggcttaggcttgggctcagcttttgaccctcaggcatctcctttcccttcctgtcttcctctcccttctcctctgctgcagcatgattttcttaatcttcagacactcactattttcatgaacagttaccctctgtccccacaaccaaagacaactcatggcctcctttggcccttgtgtaacattgcaaacctgtggctttgcaaaatgtacccaggtcacaaggggatttttttttttttagcaatgatatccctgtctgggtcactttttaagcttgtaaccgcccccccagacttataatcttaaatgtattttcctttgtttaagctgctgcttcctctgtttcattggattgtgccagttatcagtggctcttgggttcaaagtaataaagaattccaaaactga

SEQ ID NO: 285690 - DNA, 1264 bp, Homo sapiens
tgaagagaattaacaagagaaaaagttagacattttctcttgttaattctgtatcctgttatttacagctgaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaatattctttccaagagcttttaatgaagcagagagctagtacttcattttcactggatacattttcagcatcatgagttgtcacagcctctgagcccctgatctgaagccagaagggctgagtgtattgtaaacttattcttgcatgttgctgtctgggaatggaccacactacagcaggtagttctgggggcgatactgccgaaaggcccgaacacatgtattttggctgcaattgaggaacttgggatgctattaattttgtatttcagcaactgccccttctcctatcccaaagcaccaattactgccctctgcctcagcagtaccagtataagatgacattccaaagactggaggcaactcagcctgagttaattcacaaaattatgccatgctggggcttgagcttgagcttgggcttaggcttgggctcagcttttgaccctcaggcatctcctttcccttcctgtcttcctctcccttctcctctgctgcagcatgattttcttaatcttcagacactcactattttcatgaacagttaccctctgtccccacaaccaaagacaactcatggcctcctttggcccttgtgtaacattgcaaacctgtggctttgcaaaatgtacccaggtcacaaggggatttttttttttttagcaatgatatccctgtctgggtcactttttaagcttgtaaccgcccccccagacttataatcttaaatgtattttcctttgtttaagctgctgcttcctctgtttcattggattgtgccagttatcagtggctcttgggttcaaagtaataaagaattccaaaactga

SEQ ID NO: 285691 - DNA, 1222 bp, Homo sapiens
  misc_feature (142)..(142): n is a, c, g, or t
agctgaagagaaactattttaacttaagtgtaaaatggtttagaatagcaaatgatacagtccactcagagtttacaaaaaaaaacatttaccaggtagacacttaataaataaaacagcacttggacaaagttctttgaanacgaccggtaccgaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaatattctttccaagagcttttaatgaagcagagagctagtacttcattttcactggatacattttcagcatcatgagttgtcacagcctctgagcccctgatctgaagccagaagggctgagtgtattgtaaacttattcttgcatgttgctgtctgggaatggaccacactacagcaggtagttctgggggcgatactgccgaaaggcccgaacacatgtattttggctgcaattgaggaacttgggatgctattaattttgtatttcagcaactgccccttctcctatcccaaagcaccaattactgccctctgcctcagcagtaccagtataagatgacattccaaagactggaggcaactcagcctgagttaattcacaaaattatgccatgctggggcttgagcttgagcttgggcttaggcttgggctcagcttttgaccctcaggcatctcctttcccttcctgtcttcctctcccttctcctctgctgcagcatgattttcttaatcttcagacactcactattttcatgaacagttaccctctgtccccacaaccaaagacaactcatggcctcctttggcccttgtgtaacattgcaaacctgtggctttgcaaaatgtacccaggtcacaaggggatttttttttttttagcaatgatatccctgtctgggtcactttttaagcttgtaaccgcccccccagacttataatcttaaatgtattttcctttgtttaagctgctgcttcctctgtttcattggattgtgccagttatcagtggctcttgggttcaaagtaataaagaattccaaaactga

SEQ ID NO: 285692 - DNA, 1019 bp, Homo sapiens
cactcatggcctcctttggttgtagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaatattctttccaagagcttttaatgaagcagagagctagtacttcattttcactggatacattttcagcatcatgagttgtcacagcctctgagcccctgatctgaagccagaagggctgagtgtattgtaaacttattcttgcatgttgctgtctgggaatggaccacactacagcaggtagttctgggggcgatactgccgaaaggcccgaacacatgtattttggctgcaattgaggaacttgggatgctattaattttgtatttcagcaactgccccttctcctatcccaaagcaccaattactgccctctgcctcagcagtaccagtataagatgacattccaaagactggaggcaactcagcctgagttaattcacaaaattatgccatgctggggcttgagcttgagcttgggcttaggcttgggctcagcttttgaccctcaggcatctcctttcccttcctgtcttcctctcccttctcctctgctgcagcatgattttcttaatcttcagacactcactattttcatgaacagttaccctctgtccccacaaccaaagacaactcatggcctcctttggcccttgtgtaacattgcaaacctgtggctttgcaaaatgtacccaggtcacaaggggatttttttttttttagcaatgatatccctgtctgggtcactttttaagcttgtaaccgcccccccagacttataatcttaaatgtattttcctttgtttaagctgctgcttcctctgtttcattggattgtgccagttatcagtggctcttgggttcaaagtaataaagaattccaaaactga

SEQ ID NO: 285693 - DNA, 1470 bp, Homo sapiens
ggccgtgcaggggcgggctccgagcgtggggtgggcgcttgcgcactgccgctgcggctgttgctgcggagccaggaggggaagcgatggctgggcccgcgtggatctccaaggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctaccgcacgtgagcagtatcagccatctctctcctacccgctccacagcctactgctggctgtcctgtatgtgagctagcagctttttaatctacctggaactaaggccaaaaattatcagccctttcgttctggaaggagagctgatctcatttgtcacctgaacaaaaagcaatacttaaactgaattaaaactacccacacgtgaagcttc

SEQ ID NO: 285694 - DNA, 1189 bp, Homo sapiens
ggccgtgcaggggcgggctccgagcgtggggtgggcgcttgcgcactgccgctgcggctgttgctgcggagccaggaggggaagcgatggctgggcccgcgtggatctccaaggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttaggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaaggtaacaggaatcttgatttacttgtgctgggtaaaatgcattgcttccatgtgttttatctgagtgaaagggacagtgacagataatagttctcaggcgggcccaagcatttgatgttgaacaaggattcttaacgtgggtcccagattgaacagggtatgtgtgcacatg

SEQ ID NO: 285695 - DNA, 889 bp, Homo sapiens
ggccgtgcaggggcgggctccgagcgtggggtgggcgcttgcgcactgccgctgcggctgttgctgcggagccaggaggggaagcgatggctgggcccgcgtggatctccaaggtctctcggctgctgggggcattccacaacccaaaacaggtgaccagaggttttactggtggtatcaactttgccaagcttatgtagattactcttagatttaagcagacagttttatagaggaactaagaaaaaaatggaagctctcttgataaaaagtctgattttccctgagtaccaaaacagacctcagtaatattttggaaatgtgtctgaaaatgttttgcaagactgaagaagttgcatgagaagctttccaggatcacaatggaaaggaaaggaaaacacttgccttcatgagaaaccgtctaaattttagttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgaggggaccagactctttcctcttaacacgcg

SEQ ID NO: 285696 - DNA, 2612 bp, Homo sapiens
ggccgtgcaggggcgggctccgagcgtggggtgggcgcttgcgcactgccgctgcggctgttgctgcggagccaggaggggaagcgatggctgggcccgcgtggatctccaaggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattctaaaccattttacacttaagttaaaatagtttctcttcagctgtaaataacaggatacagaattaacaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaatattctttccaagagcttttaatgaagcagagagctagtacttcattttcactggatacattttcagcatcatgagttgtcacagcctctgagcccctgatctgaagccagaagggctgagtgtattgtaaacttattcttgcatgttgctgtctgggaatggaccacactacagcaggtagttctgggggcgatactgccgaaaggcccgaacacatgtattttggctgcaattgaggaacttgggatgctattaattttgtatttcagcaactgccccttctcctatcccaaagcaccaattactgccctctgcctcagcagtaccagtataagatgacattccaaagactggaggcaactcagcctgagttaattcacaaaattatgccatgctggggcttgagcttgagcttgggcttaggcttgggctcagcttttgaccctcaggcatctcctttcccttcctgtcttcctctcccttctcctctgctgcagcatgattttcttaatcttcagacactcactattttcatgaacagttaccctctgtccccacaaccaaagacaactcatggcctcctttggcccttgtgtaacattgcaaacctgtggctttgcaaaatgtacccaggtcacaaggggatttttttttttttagcaatgatatccctgtctgggtcactttttaagcttgtaaccgcccccccagacttataatcttaaatgtattttcctttgtttaagctgctgcttcctctgtttcattggattgtgccagttatcagtggctcttgggttcaaagtaataaagaattccaaaactga

SEQ ID NO: 285697 - DNA, 2437 bp, Homo sapiens
ggccgtgcaggggcgggctccgagcgtggggtgggcgcttgcgcactgccgctgcggctgttgctgcggagccaggaggggaagcgatggctgggcccgcgtggatctccaaggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattctaaaccattttacacttaagttaaaatagtttctcttcagctgtaaataacaggatacagaattaacaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaatattctttccaagagcttttaatgaagcagagagctagtacttcattttcactggatacattttcagcatcatgagttgtcacagcctctgagcccctgatctgaagccagaagggctgagtgtattgtaaacttattcttgcatgttgctgtctgggaatggaccacactacagcaggtagttctgggggcgatactgccgaaaggcccgaacacatgtattttggctgcaattgaggaacttgggatgctattaattttgtatttcagcaactgccccttctcctatcccaaagcaccaattactgccctctgcctcagcagtaccagtataagatgacattccaaagactggaggcaactcagcctgagttaattcacaaaattatgccatgctggggcttgagcttgagcttgggcttaggcttgggctcagcttttgaccctcaggcatctcccagctctgcctgtgttttcgtatcctaacctcggccggcgtctaccagcgggctgctctagagttctccagccagcatgcctg

SEQ ID NO: 285698 - DNA, 886 bp, Homo sapiens
tactccactagatgctactgctgatgatgttgaagacaaaaaagtcatgatggttgttgatgatagaggaaatcattgttgccgttgttttctttcattttttttttttgtagatggggtctcactctgtcacccaggctggagtgaagtggcgtgatcttggctcaccacatcctgcacctgctgggctcaatcgaccctcccgccttagcctccttagtggctgggaccacaggtgcatgccatcacacctggctaatttttgtgtttttggtagagacagagtttctccatgttgcccagcctggtctcaaactactgagctcaacaactgccccttctcctatcccaaagcaccaattactgccctctgcctcagcagtaccagtataagatgacattccaaagactggaggcaactcagcctgagttaattcacaaaattatgccatgctggggcttgagcttgagcttgggcttaggcttgggctcagcttttgaccctcaggcatctcctttcccttcctgtcttcctctcccttctcctctgctgcagcatgattttcttaatcttcagacactcactattttcatgaacagttaccctctgtccccacaaccaaagacaactcatggcctcctttggcccttgtgtaacattgcaaacctgtggctttgcaaaatgtacccaggtcacaaggggatttttttttttttagcaatgatatccctgtctgggtcactttttaagcttgtaaccgcccccccagacttataatcttaaatgtattttcctttgtttaagctgctgcttcctctgtttcattggattgtgccagttatcagtggctcttgggttcaaagtaataaagaattccaaaactga

SEQ ID NO: 285699 - DNA, 938 bp, Homo sapiens
ggccgtgcaggggcgggctccgagcgtggggtgggcgcttgcgcactgccgctgcggctgttgctgcggagccaggaggggaagcgatggctgggcccgcgtggatctccaaggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcattttattgattacattacggcggatgtcagatgggttttctaaaagaatgcggaacgtgagaaagctgtaaagattaaattaatgaatgtgcttgatacggctgttgatttggacagatctgcaatggagtgtgttgcaatgttgggatcttatgttggtgagatgaggggtcggtgaaaggaatggcaagggtgattgttttgggtcactgggcgaggaacagcgggagatggacggtaga

SEQ ID NO: 285700 - DNA, 476 bp, Homo sapiens
ggccagctccgactcctccagaacccgacgctgtgcagtctcctttttcaggaactcgatctccctgggcacaggcaagggacagatggcagagccccatgccagcgtgtgatgatgacacagtcactggtttgcagatgcacaagaacaacgatcaactatggctttgcccatcatggtgatgagaacaatactggacatctagaagctccacagggaacagctccaacctctccacacgcttctccagctcgtactcagcagaggctgccatgggatccacatcctcgttgcgacgatcgtaatcctcgttggaggggcccaggagactgaggaggggacagcctctgacactgcccacagcgaacccaggcgccatggggctccgaggccacccctgccttggcatctcctgtacccctctgttgtctctctccaatgtctctcagcaaaaagaggaattcctcagctctgac

SEQ ID NO: 285701 - DNA, 761 bp, Homo sapiens
aaacctatgcctcctttcctgacttgctctgttaaaaggcgccacaacctcatagccatgttggcactcagtctcaggccagtatttgctgcaaacatcccttgctctctgtcccccagccacacaggccttcctgcagatcctcagacttgccacagggcctttacgtgtgctgtcccctctgcctggaatgtcccccatctaccctcctgcttgcctagttatttccctctagctcacccttcagctctctgctgtgtgtcacttctccaaaaaagcccccacagctccctccaacagcacagccctactcccacctccacccgaatcaggttcctcctgctttagcagctcagtaagcctgttctctcctacagagccccatgccagcgtgtgatgatgacacagtcactggtttgcagatgcacaagaacaacgatcaactatggctttgcccatcatggtgatgagaacaatactggacatctagaagctccacagggaacagctccaacctctccacacgcttctccagctcgtactcagcagaggctgccatgggatccacatcctcgttgcgacgatcgtaatcctcgttggaggggcccaggagactgaggaggggacagcctctgacactgcccacagcgaacccaggcgccatggggctccgaggccacccctgccttggcatctcctgtacccctctgttgtctctctccaatgtctctcagcaaaaagaggaattcctcagctctgac

SEQ ID NO: 285702 - DNA, 743 bp, Homo sapiens
ctcagacgccccctcttgaactggcttttcccactcctccctttctaaaacgaagatgcggctgggggccttcccctccaacgagggatcgagggccgcggggcgagcactgagtcggatccctggctctggggccaggccaggccttggcccgctgatagacctcgaagatggccatcatcttttctccttacctcagtgtccttggctcggggcccagggaactggcagcctggtctccggcatcggatgggaccggggggcggggagggggtgaatggggcagtgatttgaagaggggtcgcggaggctgggcctgaggcgcggctgtcctcaccgctcccgcagacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggtgagctgggcgaggtgggccagggaagcctgtttcctggagttcagggccaggatctccaggccaaacccagagaaggagttgggtgaagagtacccgaggacacagctccctcctgcctccttccca

SEQ ID NO: 285703 - DNA, 2572 bp, Homo sapiens
ctttcaccgggtgcctcccccgggctgcaaagggtggggggcgggggtagggggagccaatcccggcagcgccaaagaggggaggaggcggtgacagccgcggggagggggcgggaggagagagtgccgctcgtgctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaacattagccgccccagcctccctccgcccccacagaccccgcctgctggacccagacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatg

SEQ ID NO: 285704 - DNA, 2518 bp, Homo sapiens
ctttcaccgggtgcctcccccgggctgcaaagggtggggggcgggggtagggggagccaatcccggcagcgccaaagaggggaggaggcggtgacagccgcggggagggggcgggaggagagagtgccgctcgtgctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaaacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatg

SEQ ID NO: 285705 - DNA, 2397 bp, Homo sapiens
ctttcaccgggtgcctcccccgggctgcaaagggtggggggcgggggtagggggagccaatcccggcagcgccaaagaggggaggaggcggtgacagccgcggggagggggcgggaggagagagtgccgctcgtgctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccgggggccatgcggggccagggccgcaaggagagtttgtccgattcccgagacctggacggctcctacgaccagctcacggacagcgtggacgatgaatttgaattgtccaccgtgtgtcaccggcctgagggtctggagcagctgcaggagcaaaccaaattcacgcgcaaggagttgcaggtcctgtaccggggcttcaagaaccctggtgccctctccttccaggaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatg

SEQ ID NO: 285706 - DNA, 2347 bp, Homo sapiens
ctttcaccgggtgcctcccccgggctgcaaagggtggggggcgggggtagggggagccaatcccggcagcgccaaagaggggaggaggcggtgacagccgcggggagggggcgggaggagagagtgccgctcgtgctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacggacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatg

SEQ ID NO: 285707 - DNA, 2314 bp, Homo sapiens
ctttcaccgggtgcctcccccgggctgcaaagggtggggggcgggggtagggggagccaatcccggcagcgccaaagaggggaggaggcggtgacagccgcggggagggggcgggaggagagagtgccgctcgtgctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacggacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatg

SEQ ID NO: 285708 - DNA, 2442 bp, Homo sapiens
ctttcaccgggtgcctcccccgggctgcaaagggtggggggcgggggtagggggagccaatcccggcagcgccaaagaggggaggaggcggtgacagccgcggggagggggcgggaggagagagtgccgctcgtgctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaacattagccgccccagcctccctccgcccccacagaccccgcctgctggacccagacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatg

SEQ ID NO: 285709 - DNA, 1311 bp, Homo sapiens
ctttcaccgggtgcctcccccgggctgcaaagggtggggggcgggggtagggggagccaatcccggcagcgccaaagaggggaggaggcggtgacagccgcggggagggggcgggaggagagagtgccgctcgtgctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaaacagcgtggacgatgaatttgaattgtccaccgtgtgtcaccggcctgagggtctggagcagctgcaggagcaaaccaaattcacgcgcaaggagttgcaggtcctgtaccggggcttcaagaacaagtcttccctcccatcacatgagccacgtggtgagtcctctggaggcttgaagattatccccctccctgggagtcttgggccatggagggtgggggcggtgaacggaaggggattttgtctctgccctcagcctggtgccctctccttccaggaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggtacagctccctgccctctacattaccctgacctggactcaggcctgatttagtaatgcagggaa

SEQ ID NO: 285710 - DNA, 682 bp, Homo sapiens
gctgggtgggacgaggggagggtttgggcggggcaaggctggggctgggcggatctgagttggtccccgaaggcccggagctctgaccctcagacgccccctcttgaactggcttttcccactcctccctttctaaaacgaagatgcggctgggggccttcccctccaacgagggatcgagggccgcggggcgagcactgagtcggatccctggctctggggccaggccaggccttggcccgctgatagacctcgaagatggccatcatcttttctccttacctcagtgtccttggctcggggcccagggaactggcagcctggtctccggcatcggatgggaccggggggcggggagggggtgaatggggcagtgatttgaagaggggtcgcggaggctgggcctgaggcgcggctgtcctcaccgctcccgcagacagcgtggacgatgaatttgaattgtccaccgtgtgtcaccggcctgagggtctggagcagctgcaggagcaaaccaaattcacgcgcaaggagttgcaggtcctgtaccggggcttcaagaacgtgagtgcaaggcgaggccaaactcagcgagggtgggacaggaggacccaagccggtccacagcttcccagaaagcatggcttggatgcttgaggtgtgggcggaagggaggcaaggccct

SEQ ID NO: 285711 - DNA, 2087 bp, Homo sapiens
tggagcttagacgccgagctcgccgccaaaccatgaaccgatgcccccgcaggtgccggagcccgctggggcaggcagcgcgatccctctaccagctggtgactgggtcgctgtccccagacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatg

SEQ ID NO: 285712 - DNA, 2422 bp, Homo sapiens
ctttcaccgggtgcctcccccgggctgcaaagggtggggggcgggggtagggggagccaatcccggcagcgccaaagaggggaggaggcggtgacagccgcggggagggggcgggaggagagagtgccgctcgtgctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacggacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatg

SEQ ID NO: 285713 - DNA, 2376 bp, Homo sapiens
ctttcaccgggtgcctcccccgggctgcaaagggtggggggcgggggtagggggagccaatcccggcagcgccaaagaggggaggaggcggtgacagccgcggggagggggcgggaggagagagtgccgctcgtgctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccgggggccatgcggggccagggccgcaaggagagtttgtccgattcccgagacctggacggctcctacgaccagctcacggacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatg

SEQ ID NO: 285714 - DNA, 2472 bp, Homo sapiens
ctttcaccgggtgcctcccccgggctgcaaagggtggggggcgggggtagggggagccaatcccggcagcgccaaagaggggaggaggcggtgacagccgcggggagggggcgggaggagagagtgccgctcgtgctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaaacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatg

SEQ ID NO: 285715 - DNA, 2571 bp, Homo sapiens
ctttcaccgggtgcctcccccgggctgcaaagggtggggggcgggggtagggggagccaatcccggcagcgccaaagaggggaggaggcggtgacagccgcggggagggggcgggaggagagagtgccgctcgtgctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaattggccgggtcttccgctttctcggtgacagttcgctcccttcagcattagccgccccagcctccctccgcccccacagaccccgcctgctggacccagacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatg

SEQ ID NO: 285716 - DNA, 2501 bp, Homo sapiens
ctttcaccgggtgcctcccccgggctgcaaagggtggggggcgggggtagggggagccaatcccggcagcgccaaagaggggaggaggcggtgacagccgcggggagggggcgggaggagagagtgccgctcgtgctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaacattagccgccccagcctccctccgcccccacagaccccgcctgctggacccagacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatg

SEQ ID NO: 285717 - DNA, 2549 bp, Homo sapiens
ctttcaccgggtgcctcccccgggctgcaaagggtggggggcgggggtagggggagccaatcccggcagcgccaaagaggggaggaggcggtgacagccgcggggagggggcgggaggagagagtgccgctcgtgctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaaacagcgtggacgatgaatttgaattgtccaccgtgtgtcaccggcctgagggtctggagcagctgcaggagcaaaccaaattcacgcgcaaggagttgcaggtcctgtaccggggcttcaagaacaagtcttccctcccatcacatgagccacgtggaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatg

SEQ ID NO: 285718 - DNA, 1999 bp, Homo sapiens
  misc_feature (1846)..(1846): n is a, c, g, or t
  misc_feature (1848)..(1849): n is a, c, g, or t
  misc_feature (1852)..(1852): n is a, c, g, or t
  misc_feature (1856)..(1856): n is a, c, g, or t
ctttcaccgggtgcctcccccgggctgcaaagggtggggggcgggggtagggggagccaatcccggcagcgccaaagaggggaggaggcggtgacagccgcggggagggggcgggaggagagagtgccgctcgtgctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacggacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatggtngnnggnttgntttttgtggtgtggtgttttggttttgggggtttatttgttggaggtatttttgaagttttatagattatataaagattttaatgaaaagtggtaaaaaattgggttttattgtgttgtagtgtttagtaatatatattatgt

SEQ ID NO: 285719 - DNA, 2196 bp, Homo sapiens
accaaaccacttggctgcccgggcatcctctctttcccacatggggaggccaccctccagggcccactaaaaaagcgctgaagcagcgattcctcaagctgctgccgtgctgcgggccccaagccctgccctcagtcagtgaaacattagccgccccagcctccctccgcccccacagaccccgcctgctggacccagacagcgtggacgatgaatttgaattgtccaccgtgtgtcaccggcctgagggtctggagcagctgcaggagcaaaccaaattcacgcgcaaggagttgcaggtcctgtaccggggcttcaagaacaagtcttccctcccatcacatgagccacgtggaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatg

SEQ ID NO: 285720 - DNA, 908 bp, Homo sapiens
ctttcaccgggtgcctcccccgggctgcaaagggtggggggcgggggtagggggagccaatcccggcagcgccaaagaggggaggaggcggtgacagccgcggggagggggcgggaggagagagtgccgctcgtgctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccgggggccatgcggggccagggccgcaaggagagtttgtccgattcccgagacctggacggctcctacgaccagctcacggacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggtacagctccctgccctctacattaccctgacctggactcaggcctgatttagtaatgcagggaa

SEQ ID NO: 285721 - DNA, 1061 bp, Homo sapiens
ctttcaccgggtgcctcccccgggctgcaaagggtggggggcgggggtagggggagccaatcccggcagcgccaaagaggggaggaggcggtgacagccgcggggagggggcgggaggagagagtgccgctcgtgctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaaacagcgtggacgatgaatttgaattgtccaccgtgtgtcaccggcctgagggtctggagcagctgcaggagcaaaccaaattcacgcgcaaggagttgcaggtcctgtaccggggcttcaagaacaagtcttccctcccatcacatgagccacgtggtgagtcctctggaggcttgaagattatccccctccctgggagtcttgggccatggagggtgggggcggtgaacggaaggggattttgtctctgccctcagcctggtgccctctccttccaggaatgtcccagcggaattgtcaatgaggagaacttcaagcagatttactcccagttctttcctcaaggaggtgaggggacaaggcccaaggggaagcagttgtccttctctaggctgagggagggagggattctggaggagctgggaatgccaaggtgatggggggtatggggagctccttagagggaggaagtcctctcctgtgtggaagccaacttctccacactcaccc

SEQ ID NO: 285722 - DNA, 4907 bp, Homo sapiens
cggccgccgccgctccagcggctccagggtcgaagccataggggaagccgcttctcggttacctcggccagcttggcttccgtggaggccgctcctcgctttctgaggctcaaacgcaagccaccgcccgaaaggccgccgatctgaggagcgcaaccgccagcccaccgctggcctaccgcagccctgtccaggtacagagccagagcgccggccggaagtggaagtgacgctttccgagggtggcgcaggcccgccctctggctaaggcgcctgagcccggcctacttcctcgccagagaaactgctgtcttccccggcggtagggaagggttaatgccaccgagtatccagacccgctgaagcctagagggccttgtaccggctcaccgcgtggctgtcgctgtctcgtgtccccagtgggggaggcgtcgcactgccacgtctgttctgcgtggctgtcgggcggcgtttggtcccgggagcctcgccgggtaagggtcgcctcccagctgcgcgcgccgcgttctcgggcttcccgcggcccggccggccgtgctcgagctgttgctgggctcgtcgccgcctcctcgaggaagaggcattttgtccgggtcgggccactcgctaggtcagaaacagcggccccccgagggttttgtaccgttttctaggtctcgtgacgcattccccacaactattttttcttgaggtaggtttgaacctgtgaaataggttctttttctatctctccttgacagagaaacggagacctaagaagtgacttgctcagggtcacatagctcagcagtggcggccgctaatcggaaatagctctcctgttgtggtatcctctgcgttttccactccagtattcttccctggaaaatgggaaccttgttttcatcttatatctcatgcagcgcctaacatagtcacctggtaagataggcattccacacatatttactgaatcatagttataagaatctgagtgttttgggtgttcagtgatctctgaattaatccgtttttgtaatgtcagtctgtaccagttgagggattatttaataagtccagtatgagtggtttcggaattaccagtttttgtaacgtcagcttataccagtcaagggactatttattaagtcagctatgtgtagccaatattgcagagttgagtaagaagtctttgtccttaagcaatctcttgaaaggactgagcaatttcgtgaatatcagtaacacaagggtaagaataggacataaactgaatgctgtgagaactccaagaaaatccaagttgatttggggttgggggaaattataaaagaccttgagggattttgtccacagcagggaatggagacactttccaggcagagggaagggtaggagtaaaggctttaaaagctggaaacattagactgtgagatcttaggtacgtttttactgagttgggctgcatttagaggaagagttttaaaagttagaaaacgagtttatgtggcacttatactggagtcctttgaatgggaatgaaaagagtgcatttaagaaagtaaatcctggccgggcgcggtggcttacgcctgtaatcccagcactttgggaggccgaggcgggcggatcatgaggtcaggagatcgagaccatcctggctaacatggtgaaaccccgtctctactaaaaaatacaaaaaaaaattagccgggcgtggtggtgggcgcctgtagtcccagctactcgggaggctgaggcaggagaatggcgtgaacccgggaggcggagcttgcagtgagccgagttcacgccactgcattccagcctgggcgacagagcgagactccgtcgcaaaaaacaaaacaaaacaatacaaaaaagtaaatcctggagcaccatttgagcgttttggactgagctgctttctatggcagttcatctaagcacctggaatggataaaagtggcagtttttgtttcttcccatgaggttgtgtatctggactgagaaccaggaaattaatctagactaagacatttctaaggacctggaatggctttggggagcaccaggaggacccgaaaagagtatttgagggcctagagggacagaagagtttgccagtaggatttatgagaaacaattgatcagaaacagcagcagagaaaccttttagatttcttctgtggaaaagttgagtcttggttcaaattaagtaaaataaacactgaagagaaatcaaaatctcaaatataaaaagtatgttacttatagtgtaaatttaggaaaacaaatgaaaggacagatctttaaaaatttttaactatggtgaaatatttgtaaaacttttgggctcatctctgagaattgctgtgattctgaaactttgataatatctcaaatagagaacagtttcagtgaaaaatagcacttgagaataaatcagatgttcccaagaaagaagatctgagaatggtaaagtgccactgacaaataaattatttacatacttacatattaccttggcaaacacaagagacattcaagttaaagcacggtgcttgacaatactatattgaatgcaataaaagttggatttcattcatatgtacaacaaactactttcttcttcacttcaagattcggtacaactgttcctgaattccaactctccatacatcccaatgtcagggtccctgtagctcggagcccttatccaggtagatgaactgctgcccagtgaacactatgtacaaagcaatttgagcaccattctcttttctggcagtgaggtaaaatcaggtctttttggaaggggagaagccacattgcatctctgctacacacaagattactctgtcattgcctttgagtctttcacgctcccttcttctgaagcatcagtttttatggaaacttatcacacctgtcttgtgggcacatcttgctccatccctcctctcttcatattgtccgttttccggtattgagttagggaaagtatgcaggtattcctgtcattcctgactgaggctgttgtatctgtcaaaagagaggagaggtagggggcattctgaaaaatgatcactcatggcttgcaggagcaagagccagacaggactttgcaactggcagctttctgagtgcataagacctccacctctagactagctcttcagtcatggttagccccttcagtccattatcctccaatacaatgcccatgccttctggggctttcagctaagttttgtttaaaaaatgtgggttttttttttgccaattcattaaggcttttccctttgttttctcctgttggtggttcagagttaaattcagtatgaataagagagggaaatatacaacactgaatttggaggagaaaatgaaggttctaagtagaattgaagctggacgatcacttaaaagtgtaatggatgaatttggaatcagtaagtcaacattttatgacattaaaaaaaataagaagttaattctggactttgtactgaagcaggacatgccattagtaggggctgagaagagaaagaggacaacgggagccaaatatggtgatgtagatgatgcggtctacatgtggtaccaacagaaacgctcagccggtgttccggtaagaggcgtggagcttcaggctgctgcagagagatttgcacggtgttttgggcgaacagatttcaaagctagcactggttggctttttagatttcgaaatcggcatgcaattgggaaccgaaaaggatgtggggaacaagtcctaagttcagtttctgaaaatgttgagccatttcgacaaaaactgtccatgataatcaaagaggagaaactgtgtctagctcagctatacagtggggatgaaacagacctcttttggaagtcaatgccagaaaattctcaggcaagtaggaaagatatctgcctaccagggaagaaaataaacaaagaaaggttgtctgcctttttatgtgcaaatgcagacggaactcataaattaaagtcaatcattattggaaaatcaaaactgcccaaaagtgtgaaagaggacacaagtacattgcctgtgatatataaacccagtaaagatgtttggttcaccagagaattgttttcagaatggttttttcaaaactttgttcctgaggtccgacattttcaacttaatgttctaagatttcatgacgaggacgtcagggcattgttacttctggacagttgcccggctcatccttcctctgaatccctaaccagtgaggatggtcgaataaaatgtatgttcttcccccataacagttcaaccttgattcaaccaatgaatcaaggtgtgatcttgagctgcaaacggctgtatagatggaagcaacttgaagagagtcttgtaatatttgaagaaagtgatgatgagcaagagaaaggagataaaggagtttccaaaattaaaatctacaatataaaaagtgcaatttttaactgggcaaaaagttgggaagaagtaaaacaaataaccatagcaaatgcatgggaaaatcttctttacaaaaaggaacctgaatatgattttcaaggcttagaacatggggattatagagaaattcttgaaaaatgtggggagttggaaactaagttggatgatgatagggtgtggttaaatggagatgaagaaaagggttgtctcctaaaaaccaaaggtggaataacaaaggaagttgttcaaaaaggaggagaagctgagaagcagactgctgaatttaaattatctgctgtaagagagagtttggactaccttcttgactttgttgatgccacacctgagtttcagagattccacttcacactgtgtgagttctctgatgactcataagacgggaactccgagagaagctttctcc

SEQ ID NO: 285723 - DNA, 3454 bp, Homo sapiens
cggccgccgccgctccagcggctccagggtcgaagccataggggaagccgcttctcggttacctcggccagcttggcttccgtggaggccgctcctcgctttctgaggctcaaacgcaagccaccgcccgaaaggccgccgatctgaggagcgcaaccgccagcccaccgctggcctaccgcagccctgtccaggtacagagccagagcgccggccggaagtggaagtgacgctttccgagggtggcgcaggcccgccctctggctaaggcgcctgagcccggcctacttcctcgccagagaaactgctgtcttccccggcggtagggaagggttaatgccaccgagtatccagacccgctgaagcctagagggccttgtaccggctcaccgcgtggctgtcgctgtctcgtgtccccagtgggggaggcgtcgcactgccacgtctgttctgcgtggctgtcgggcggcgtttggtcccgggagcctcgccggcacctggaatggataaaagtggcagtttttgtttcttcccatgaggttgtgtatctggactgagaaccaggaaattaatctagactaagacatttctaaggacctggaatggctttggggagcaccaggaggacccgaaaagagtatttgagggcctagagggacagaagagtttgccagtaggatttatgagaaacaattgatcagaaacagcagcagagaaaccttttagatttcttctgtggaaaagttgagtcttggttcaaattaagtaaaataaacactgaagagaaatcaaaatctcaaatataaaaagtatgttacttatagtgtaaatttaggaaaacaaatgaaaggacagatctttaaaaatttttaactatggtgaaatatttgtaaaacttttgggctcatctctgagaattgctgtgattctgaaactttgataatatctcaaatagagaacagtttcagtgaaaaatagcacttgagaataaatcagatgttcccaagaaagaagatctgagaatggtaaagtgccactgacaaataaattatttacatacttacatattaccttggcaaacacaagagacattcaagttaaagcacggtgcttgacaatactatattgaatgcaataaaagttggatttcattcatatgtacaacaaactactttcttcttcacttcaagattcggtacaactgttcctgaattccaactctccatacatcccaatgtcagggtccctgtagctcggagcccttatccaggtagatgaactgctgcccagtgaacactatgtacaaagcaatttgagcaccattctcttttctggcagtgaggtaaaatcaggtctttttggaaggggagaagccacattgcatctctgctacacacaagattactctgtcattgcctttgagtctttcacgctcccttcttctgaagcatcagtttttatggaaacttatcacacctgtcttgtgggcacatcttgctccatccctcctctcttcatattgtccgttttccggtattgagttagggaaagtatgcaggtattcctgtcattcctgactgaggctgttgtatctgtcaaaagagaggagaggtagggggcattctgaaaaatgatcactcatggcttgcaggagcaagagccagacaggactttgcaactggcagctttctgagtgcataagacctccacctctagactagctcttcagtcatggttagccccttcagtccattatcctccaatacaatgcccatgccttctggggctttcagctaagttttgtttaaaaaatgtgggttttttttttgccaattcattaaggcttttccctttgttttctcctgttggtggttcagagttaaattcagtatgaataagagagggaaatatacaacactgaatttggaggagaaaatgaaggttctaagtagaattgaagctggacgatcacttaaaagtgtaatggatgaatttggaatcagtaagtcaacattttatgacattaaaaaaaataagaagttaattctggactttgtactgaagcaggacatgccattagtaggggctgagaagagaaagaggacaacgggagccaaatatggtgatgtagatgatgcggtctacatgtggtaccaacagaaacgctcagccggtgttccggtaagaggcgtggagcttcaggctgctgcagagagatttgcacggtgttttgggcgaacagatttcaaagctagcactggttggctttttagatttcgaaatcggcatgcaattgggaaccgaaaaggatgtggggaacaagtcctaagttcagtttctgaaaatgttgagccatttcgacaaaaactgtccatgataatcaaagaggagaaactgtgtctagctcagctatacagtggggatgaaacagacctcttttggaagtcaatgccagaaaattctcaggcaagtaggaaagatatctgcctaccagggaagaaaataaacaaagaaaggttgtctgcctttttatgtgcaaatgcagacggaactcataaattaaagtcaatcattattggaaaatcaaaactgcccaaaagtgtgaaagaggacacaagtacattgcctgtgatatataaacccagtaaagatgtttggttcaccagagaattgttttcagaatggttttttcaaaactttgttcctgaggtccgacattttcaacttaatgttctaagatttcatgacgaggacgtcagggcattgttacttctggacagttgcccggctcatccttcctctgaatccctaaccagtgaggatggtcgaataaaatgtatgttcttcccccataacagttcaaccttgattcaaccaatgaatcaaggtgtgatcttgagctgcaaacggctgtatagatggaagcaacttgaagagagtcttgtaatatttgaagaaagtgatgatgagcaagagaaaggagataaaggagtttccaaaattaaaatctacaatataaaaagtgcaatttttaactgggcaaaaagttgggaagaagtaaaacaaataaccatagcaaatgcatgggaaaatcttctttacaaaaaggaacctgaatatgattttcaaggcttagaacatggggattatagagaaattcttgaaaaatgtggggagttggaaactaagttggatgatgatagggtgtggttaaatggagatgaagaaaagggttgtctcctaaaaaccaaaggtggaataacaaaggaagttgttcaaaaaggaggagaagctgagaagcagactgctgaatttaaattatctgctgtaagagagagtttggactaccttcttgactttgttgatgccacacctgagtttcagagattccacttcacactgtgtgagttctctgatgactcataagacgggaactccgagagaagctttctcc

SEQ ID NO: 285724 - DNA, 1771 bp, Homo sapiens
cggccgccgccgctccagcggctccagggtcgaagccataggggaagccgcttctcggttacctcggccagcttggcttccgtggaggccgctcctcgctttctgaggctcaaacgcaagccaccgcccgaaaggccgccgatctgaggagcgcaaccgccagcccaccgctggcctaccgcagccctgtccagagttaaattcagtatgaataagagagggaaatatacaacactgaatttggaggagaaaatgaaggttctaagtagaattgaagctggacgatcacttaaaagtgtaatggatgaatttggaatcagtaagtcaacattttatgacattaaaaaaaataagaagttaattctggactttgtactgaagcaggacatgccattagtaggggctgagaagagaaagaggacaacgggagccaaatatggtgatgtagatgatgcggtctacatgtggtaccaacagaaacgctcagccggtgttccggtaagaggcgtggagcttcaggctgctgcagagagatttgcacggtgttttgggcgaacagatttcaaagctagcactggttggctttttagatttcgaaatcggcatgcaattgggaaccgaaaaggatgtggggaacaagtcctaagttcagtttctgaaaatgttgagccatttcgacaaaaactgtccatgataatcaaagaggagaaactgtgtctagctcagctatacagtggggatgaaacagacctcttttggaagtcaatgccagaaaattctcaggcaagtaggaaagatatctgcctaccagggaagaaaataaacaaagaaaggttgtctgcctttttatgtgcaaatgcagacggaactcataaattaaagtcaatcattattggaaaatcaaaactgcccaaaagtgtgaaagaggacacaagtacattgcctgtgatatataaacccagtaaagatgtttggttcaccagagaattgttttcagaatggttttttcaaaactttgttcctgaggtccgacattttcaacttaatgttctaagatttcatgacgaggacgtcagggcattgttacttctggacagttgcccggctcatccttcctctgaatccctaaccagtgaggatggtcgaataaaatgtatgttcttcccccataacagttcaaccttgattcaaccaatgaatcaaggtgtgatcttgagctgcaaacggctgtatagatggaagcaacttgaagagagtcttgtaatatttgaagaaagtgatgatgagcaagagaaaggagataaaggagtttccaaaattaaaatctacaatataaaaagtgcaatttttaactgggcaaaaagttgggaagaagtaaaacaaataaccatagcaaatgcatgggaaaatcttctttacaaaaaggaacctgaatatgattttcaaggcttagaacatggggattatagagaaattcttgaaaaatgtggggagttggaaactaagttggatgatgatagggtgtggttaaatggagatgaagaaaagggttgtctcctaaaaaccaaaggtggaataacaaaggaagttgttcaaaaaggaggagaagctgagaagcagactgctgaatttaaattatctgctgtaagagagagtttggactaccttcttgactttgttgatgccacacctgagtttcagagattccacttcacactgtgtgagttctctgatgactcataagacgggaactccgagagaagctttctcc

SEQ ID NO: 285725 - DNA, 441 bp, Homo sapiens
gtagttgaggaatgaatgggccagtcagattctgccctaaagaagaggaagaataactgagataccagccatttcccttatttctctgacatacttttctttcttcgtagcacctggaatggataaaagtggcagtttttgtttcttcccatgaggttgtgtatctggactgagaaccaggaaattaatctagactaagacatttctaaggacctggaatggctttggggagcaccaggaggacccgaaaagagtatttgagggcctagagggacagaagagtttgccagtaggatttatgagaaacaattgatcagaaacagcagcagagaaaccttttagatttcttctgtggaaaagttgagtcttggttcaaattaagtaaaataaacactgaagagaaatcaaaatctcaaatataaaaagtatgttacttatagt

SEQ ID NO: 285726 - DNA, 1594 bp, Homo sapiens
tgatgacgtaattttcctgcgcctcggggcgagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaaggtttggcaaatacgtgtagacctacatttattaaatcatgatggaaatattattgatgctgccagcattgctgcaatcgtggccttatgtcatttccgaagacctgatgtctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagctttggagaatgaccaaaaagtaaggaaagaaggtggaaagtttggttttgcagagtctatagcaaatcaaaggatcacagcatttaaaatggaaaaggcccctattgatacctcggatgtagaagaaaaagcagaagaaatcattgctgaagcagaacctccttcagaagttgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaagatgctcccataatactctcagatagtgaagaagaagaaatgatcattttggaaccagacaagaatccaaagaaaataagaacacagaccaccagtgcaaaacaagaaaaagcaccaagtaaaaagccagtgaaaagaagaaaaaagaagagagctgccaattaaagctaacagttgtatatctgtatatataactattaaaagggatatttattccattctgagaaccctgggtattttttattcacaaatccattataaaatctagcaggattttaaaaatagttttttgtttttaatgtgctttaaaataataaaccttctggagca

SEQ ID NO: 285727 - DNA, 2003 bp, Homo sapiens
tgatgacgtaattttcctgcgcctcggggcgagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaaggtttggcaaatacgtgtagacctacatttattaaatcatgatggaaatattattgatgctgccagcattgctgcaatcgtggccttatgtcatttccgaagacctgatgtctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagctttggagaatgaccaaaaagtaaggaaagaaggtggaaagtttggttttgcagagtctatagcaaatcaaaggatcacagcatttaaaatggaaaaggcccctattgatacctcggatgtagaagaaaaagcagaagaaatcattgctgaagcagaacctccttcagaagttgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaagatgctcccataatactctcagatagtgaagaagaagaaatgatcattttggaaccagacaagaatccaaagaaaataagaacacagaccaccagtgcaaaacaagaaaaagcaccaagtaaaaagccagtgaaaagaagaaaaaagaagagagctgccaattaaagctaacagttgtatatctgtatatataactattaaaagggatatttattccattctgagaaccctgggtattttttattcacaaatccattataaaatctagcaggattttaaaaatagttttttgtttttaatgtgctttaaaataataaaccttctggagcatttctcgtctgttaatttgcatataagcttcccaccctcttccactcccaacctctgttgagtttacctcgcaaaacctaaacaaacaggttttacaaagagcgaaaaagtctggggaatctctactgtatctatctctgaatactgtattcagatatgcttagattagattatgcccaagtcagcaaattgatccagttgcttaggaaaatgaatgtcagaatttgagggtctgttttcctaaacctactttaattttagaggaaggcttttcacttcccattatatagtaaaccaagtaaacttctttactaagcaaaatcctgaagaagttaaatttgacttgcaaagttttccaaatcaatttattatcctgacagctggcatcattaatactttaacaaaacca

SEQ ID NO: 285728 - DNA, 1482 bp, Homo sapiens
tgatgacgtaattttcctgcgcctcggggcgagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaaggtttggcaaatacgtgtagacctacatttattaaatcatgatggaaatattattgatgctgccagcattgctgcaatcgtggccttatgtcatttccgaagacctgatgtctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagctttggagaatgaccaaaaagtaaggaaagaaggtggaaagtttggttttgcagagtctatagcaaatcaaaggatcacagcatttaaaatggaaaaggcccctattgatacctcggatgtagaagaaaaagcagaagaaatcattgctgaagcagaacctccttcagaagttgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaagatgctcccataatactctcagatagtgaagaagaagaaatgatcattttggaaccagacaagaatccaaagaaaataagaacacagaccaccagtgcaaaacaagaaaaagcaccaagtaaaaagccagtgaaaagaagaaaaaagaagagagctgccaattaaagctaacagttgtatatctgtatatataactattaaaagggatatttattcca

SEQ ID NO: 285729 - DNA, 2327 bp, Homo sapiens
tgatgacgtaattttcctgcgcctcggggcgagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaaggtttggcaaatacgtgtagacctacatttattaaatcatgatggaaatattattgatgctgccagcattgctgcaatcgtggccttatgtcatttccgaagacctgatgtctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagctttggagaatgaccaaaaagtaaggaaagaaggtggaaagtttggttttgcagagtctatagcaaatcaaaggatcacagcatttaaaatggaaaaggcccctattgatacctcggatgtagaagaaaaagcagaagaaatcattgctgaagcagaacctccttcagaagttgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaagatgctcccataatactctcagatagtgaagaagaagaaatgatcattttggaaccagacaagaatccaaagaaaataaggtaacaaatttctggtttatttcaaatgtatacatatactcaacacttatagaggtttgctctctggttttactctcatcttgccacatgactataaacaaaaagacatccctttttcattagagatccatctgttctgtgatttttttaccttgtgatttataaaaattaggacctaaatctataatataaacttcttggatgccagtcttactcatagctgacacattttagatcctactggaaaactaagaaatgcctcttatttcaataatccaaaacttaacatactcttagtaaattcttactttgctttattcacagaacacagaccaccagtgcaaaacaagaaaaagcaccaagtaaaaagccagtgaaaagaagaaaaaagaagagagctgccaattaaagctaacagttgtatatctgtatatataactattaaaagggatatttattccattctgagaaccctgggtattttttattcacaaatccattataaaatctagcaggattttaaaaatagttttttgtttttaatgtgctttaaaataataaaccttctggagcatttctcgtctgttaatttgcatataagcttcccaccctcttccactcccaacctctgttgagtttacctcgcaaaacctaaacaaacaggttttacaaagagcgaaaaagtctggggaatctctactgtatctatctctgaatactgtattcagatatgcttagattagattatgcccaagtcagcaaattgatccagttgcttaggaaaatgaatgtcagaatttgagggtctgttttcctaaacctactttaattttagaggaaggcttttcacttcccattatatagtaaaccaagtaaacttctttactaagcaaaatcctgaagaagttaaatttgacttgcaaagttttccaaatcaatttattatcctgacagctggcatcattaatactttaacaaaacca

SEQ ID NO: 285730 - DNA, 2054 bp, Homo sapiens
tgatgacgtaattttcctgcgcctcggggcgagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaaggtttggcaaatacgtgtagacctacatttattaaatcatgatggaaatattattgatgctgccagcattgctgcaatcgtggccttatgtcatttccgaagacctgatgtctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagctttggagaatgaccaaaaagtaaggaaagaaggtggaaagtttggttttgcagagtctatagcaaatcaaaggatcacagcatttaaaatggaaaaggcccctattgatacctcggatgtagaagaaaaagcagaagaaatcattgctgaagcagaacctccttcagaagttgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaagagctggggtttcaccatgttggccagactggactcgagttcctgacctcagatgctcccataatactctcagatagtgaagaagaagaaatgatcattttggaaccagacaagaatccaaagaaaataagaacacagaccaccagtgcaaaacaagaaaaagcaccaagtaaaaagccagtgaaaagaagaaaaaagaagagagctgccaattaaagctaacagttgtatatctgtatatataactattaaaagggatatttattccattctgagaaccctgggtattttttattcacaaatccattataaaatctagcaggattttaaaaatagttttttgtttttaatgtgctttaaaataataaaccttctggagcatttctcgtctgttaatttgcatataagcttcccaccctcttccactcccaacctctgttgagtttacctcgcaaaacctaaacaaacaggttttacaaagagcgaaaaagtctggggaatctctactgtatctatctctgaatactgtattcagatatgcttagattagattatgcccaagtcagcaaattgatccagttgcttaggaaaatgaatgtcagaatttgagggtctgttttcctaaacctactttaattttagaggaaggcttttcacttcccattatatagtaaaccaagtaaacttctttactaagcaaaatcctgaagaagttaaatttgacttgcaaagttttccaaatcaatttattatcctgacagctggcatcattaatactttaacaaaacca

SEQ ID NO: 285731 - DNA, 1533 bp, Homo sapiens
tgatgacgtaattttcctgcgcctcggggcgagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaaggtttggcaaatacgtgtagacctacatttattaaatcatgatggaaatattattgatgctgccagcattgctgcaatcgtggccttatgtcatttccgaagacctgatgtctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagctttggagaatgaccaaaaagtaaggaaagaaggtggaaagtttggttttgcagagtctatagcaaatcaaaggatcacagcatttaaaatggaaaaggcccctattgatacctcggatgtagaagaaaaagcagaagaaatcattgctgaagcagaacctccttcagaagttgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaagagctggggtttcaccatgttggccagactggactcgagttcctgacctcagatgctcccataatactctcagatagtgaagaagaagaaatgatcattttggaaccagacaagaatccaaagaaaataagaacacagaccaccagtgcaaaacaagaaaaagcaccaagtaaaaagccagtgaaaagaagaaaaaagaagagagctgccaattaaagctaacagttgtatatctgtatatataactattaaaagggatatttattcca

SEQ ID NO: 285732 - DNA, 2228 bp, Homo sapiens
tgatgacgtaattttcctgcgcctcggggcgagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaaggtttggcaaatacgtgtagacctacatttattaaatcatgatggaaatattattgatgctgccagcattgctgcaatcgtggccttatgtcatttccgaagacctgatgtctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagctttggagaatgaccaaaaagtaaggaaagaaggtggaaagtttggttttgcagagtctatagcaaatcaaaggatcacagcatttaaaatggaaaaggcccctattgatacctcggatgtagaagaaaaagcagaagaaatcattgctgaagcagaacctccttcagaagttgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaagagctggggtttcaccatgttggccagactggactcgagttcctgacctcaggtaatccacctgcctcagcctaccaaaatgtgggtattaaaagtgtgagccaccacgcccagccccagaaataagagtttagaacgtctgatagaaataaattcatgtagaaataaattttgcaagagattgcttaacttttttttttttttttaaattaataaaaaaacaaagatgctcccataatactctcagatagtgaagaagaagaaatgatcattttggaaccagacaagaatccaaagaaaataagaacacagaccaccagtgcaaaacaagaaaaagcaccaagtaaaaagccagtgaaaagaagaaaaaagaagagagctgccaattaaagctaacagttgtatatctgtatatataactattaaaagggatatttattccattctgagaaccctgggtattttttattcacaaatccattataaaatctagcaggattttaaaaatagttttttgtttttaatgtgctttaaaataataaaccttctggagcatttctcgtctgttaatttgcatataagcttcccaccctcttccactcccaacctctgttgagtttacctcgcaaaacctaaacaaacaggttttacaaagagcgaaaaagtctggggaatctctactgtatctatctctgaatactgtattcagatatgcttagattagattatgcccaagtcagcaaattgatccagttgcttaggaaaatgaatgtcagaatttgagggtctgttttcctaaacctactttaattttagaggaaggcttttcacttcccattatatagtaaaccaagtaaacttctttactaagcaaaatcctgaagaagttaaatttgacttgcaaagttttccaaatcaatttattatcctgacagctggcatcattaatactttaacaaaacca

SEQ ID NO: 285733 - DNA, 1295 bp, Homo sapiens
tgatgacgtaattttcctgcgcctcggggcgagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaaggtttggcaaatacgtgtagacctacatttattaaatcatgatggaaatattattgatgctgccagcattgctgcaatcgtggccttatgtcatttccgaagacctgatgtctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagctttggagaatgaccaaaaagtaaggaaagaaggtggaaagtttggttttgcagagtctatagcaaatcaaaggatcacagcatttaaaatggaaaaggcccctattgatacctcggatgtagaagaaaaagcagaagaaatcattgctgaagcagaacctccttcagaagttgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaaggtaggtgacactttatggcacacttactat

SEQ ID NO: 285734 - DNA, 1007 bp, Homo sapiens
tgatgacgtaattttcctgcgcctcggggcgagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaaggtttggcaaatacgtgtagacctacatttattaaatcatgatggaaatattattgatgctgccagcattgctgcaatcgtggccttatgtcatttccgaagacctgatgtctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagcatttactgatggggagagaggggaaaggaagggagacgagcggagagacgagtgtggggtgtggagaagccgtgtctgaatacaatgtgtgggcc

SEQ ID NO: 285735 - DNA, 1378 bp, Homo sapiens
tgatgacgtaattttcctgcgcctcggggcgagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaaggtttggcaaatacgtgtagacctacatttattaaatcatgatggaaatattattgatgctgccagcattgctgcaatcgtggccttatgtcatttccgaagacctgatgtctctgtccaaggagatgaagtaacactggttctgagatgcagtaaaatcgctggtgtgaaagtagcagaaattacagagctaatattgaaagctttggagaatgaccaaaaagtaaggaaagaaggtggaaagtttggttttgcagagtctatagcaaatcaaaggatcacagcatttaaaatggaaaaggcccctattgatacctcggatgtagaagaaaaagcagaagaaatcattgctgaagcagaacctccttcagaagttgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaagatgctcccataatactctcagatagtgaagaagaagaaatgatcattttggaaccagacaagaatccaaagaaaataagaacacagaccaccagtgcaaaacaagaaaaagcaccaagtaaaaagccagtgaaaagaagaaaaaagaagagagctgccaattaaagctaacagttgtatatctgtatatataactattaaaagggatatttattccattctgagaaccctgggtattttttattcacaaatccattataaaatctagcaggattttaaaaatagttttttgtttttaatgtgctttaaaataataaaccttctggagca

SEQ ID NO: 285736 - DNA, 2159 bp, Homo sapiens
gttgaagatgtaagttgtttccattttctcactgttaatatccttgcacttgcatatacctcttatatgtttgtttagtgtattcttctaacagtgaataatattttcaactgaatataatgaaggtggacctaagcattggaaaaatggagcaggtacagccttcctaaagcatgtgaacaaagggagaaactaattgaaaactaaaaatacaaataattgatatgggttaattcacattttatgtatatcattaactaataagcaggagaaaaatgggcaaaatacatggagcagttctcaaagtatacaatggccagtaatatttttcatggtcagccctgacagtaatacaaataaaatccaaagaaaaatgacatggcattttttgttactgtattttgggcagtattaaaaacaccagcaatgccaaaggtatatgggaaatgggttcttttatttcttggaatgtaaactggaactatttctggaggaatagagtagcacaaacaattcagttgtctctacaaaagatgctatatacatttccccctagcttttctattatgacatgtaccaaattgtcacaccattcaagcacctgtaggaaataagagtttaaagaaacaaatgttacagatgagttctagagtgctctaagaagctgatttaaagaaaagattaagcctccacctagagttttatttttattttttgggatggagtcttgctctgtcacccagactggagtgcagtggcactgcaacctccacctccatgggttcaagcgattctcatgcctcagcctcgagtagctgggcctacaagcacatgccaccacgcctggctaatttttctattatttttaatagagctggggtttcaccatgttggccagactggactcgagttcctgacctcaggtaatccacctgcctcagcctaccaaaatgtgggtattaaaagtgtgagccaccacgcccagccccagaaataagagtttagaacgtctgatagaaataaattcatgtagaaataaattttgcaagagattgcttaacttttttttttttttttaaattaataaaaaaacaaagatgctcccataatactctcagatagtgaagaagaagaaatgatcattttggaaccagacaagaatccaaagaaaataaggtaacaaatttctggtttatttcaaatgtatacatatactcaacacttatagaggtttgctctctggttttactctcatcttgccacatgactataaacaaaaagacatccctttttcattagagatccatctgttctgtgatttttttaccttgtgatttataaaaattaggacctaaatctataatataaacttcttggatgccagtcttactcatagctgacacattttagatcctactggaaaactaagaaatgcctcttatttcaataatccaaaacttaacatactcttagtaaattcttactttgctttattcacagaacacagaccaccagtgcaaaacaagaaaaagcaccaagtaaaaagccagtgaaaagaagaaaaaagaagagagctgccaattaaagctaacagttgtatatctgtatatataactattaaaagggatatttattccattctgagaaccctgggtattttttattcacaaatccattataaaatctagcaggattttaaaaatagttttttgtttttaatgtgctttaaaataataaaccttctggagcatttctcgtctgttaatttgcatataagcttcccaccctcttccactcccaacctctgttgagtttacctcgcaaaacctaaacaaacaggttttacaaagagcgaaaaagtctggggaatctctactgtatctatctctgaatactgtattcagatatgcttagattagattatgcccaagtcagcaaattgatccagttgcttaggaaaatgaatgtcagaatttgagggtctgttttcctaaacctactttaattttagaggaaggcttttcacttcccattatatagtaaaccaagtaaacttctttactaagcaaaatcctgaagaagttaaatttgacttgcaaagttttccaaatcaatttattatcctgacagctggcatcattaatactttaacaaaacca

SEQ ID NO: 285737 - DNA, 1835 bp, Homo sapiens
gttgaagatgtaagttgtttccattttctcactgttaatatccttgcacttgcatatacctcttatatgtttgtttagtgtattcttctaacagtgaataatattttcaactgaatataatgaaggtggacctaagcattggaaaaatggagcaggtacagccttcctaaagcatgtgaacaaagggagaaactaattgaaaactaaaaatacaaataattgatatgggttaattcacattttatgtatatcattaactaataagcaggagaaaaatgggcaaaatacatggagcagttctcaaagtatacaatggccagtaatatttttcatggtcagccctgacagtaatacaaataaaatccaaagaaaaatgacatggcattttttgttactgtattttgggcagtattaaaaacaccagcaatgccaaaggtatatgggaaatgggttcttttatttcttggaatgtaaactggaactatttctggaggaatagagtagcacaaacaattcagttgtctctacaaaagatgctatatacatttccccctagcttttctattatgacatgtaccaaattgtcacaccattcaagcacctgtaggaaataagagtttaaagaaacaaatgttacagatgagttctagagtgctctaagaagctgatttaaagaaaagattaagcctccacctagagttttatttttattttttgggatggagtcttgctctgtcacccagactggagtgcagtggcactgcaacctccacctccatgggttcaagcgattctcatgcctcagcctcgagtagctgggcctacaagcacatgccaccacgcctggctaatttttctattatttttaatagagctggggtttcaccatgttggccagactggactcgagttcctgacctcaggtaatccacctgcctcagcctaccaaaatgtgggtattaaaagtgtgagccaccacgcccagccccagaaataagagtttagaacgtctgatagaaataaattcatgtagaaataaattttgcaagagattgcttaacttttttttttttttttaaattaataaaaaaacaaagatgctcccataatactctcagatagtgaagaagaagaaatgatcattttggaaccagacaagaatccaaagaaaataagaacacagaccaccagtgcaaaacaagaaaaagcaccaagtaaaaagccagtgaaaagaagaaaaaagaagagagctgccaattaaagctaacagttgtatatctgtatatataactattaaaagggatatttattccattctgagaaccctgggtattttttattcacaaatccattataaaatctagcaggattttaaaaatagttttttgtttttaatgtgctttaaaataataaaccttctggagcatttctcgtctgttaatttgcatataagcttcccaccctcttccactcccaacctctgttgagtttacctcgcaaaacctaaacaaacaggttttacaaagagcgaaaaagtctggggaatctctactgtatctatctctgaatactgtattcagatatgcttagattagattatgcccaagtcagcaaattgatccagttgcttaggaaaatgaatgtcagaatttgagggtctgttttcctaaacctactttaattttagaggaaggcttttcacttcccattatatagtaaaccaagtaaacttctttactaagcaaaatcctgaagaagttaaatttgacttgcaaagttttccaaatcaatttattatcctgacagctggcatcattaatactttaacaaaacca

SEQ ID NO: 285738 - DNA, 280 bp, Homo sapiens
cattgttcagccatccatagtgtagctatattaagttttttttcccctaggaacttggggcacacttgaatcaatcttacaagaagaaaactttcattctcatcttcaacagttcatcaaatagcaatatttttgttactcagttttcttaacttgttaagtgtttctacacctgtgctatggactcctggaactgcccaaattggagagggagtagaaaactcctggggtgatcttgaagactctgagaaggaagatgatgaaggcggtggtgatcaag

SEQ ID NO: 285739 - DNA, 1806 bp, Homo sapiens
tgatgacgtaattttcctgcgcctcggggcgagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaaggtttggcaaatacgtgtagacctacatttattaaatcatgatggaaatattattgatgctgccagcattgctgcaatcgtggccttatgtcatttccgaagacctgatgtctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagctttggagaatgaccaaaaagtaaggaaagaaggtggaaagtttggttttgcagagtctatagcaaatcaaaggatcacagcatttaaaatggaaaaggcccctattgatacctcggatgtagaagaaaaagcagaagaaatcattgctgaagcagaacctccttcagaagttgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaagatgctcccataatactctcagatagtgaagaagaagaaatgatcattttggaaccagacaagaatccaaagaaaataaggtaacaaatttctggtttatttcaaatgtatacatatactcaacacttatagaggtttgctctctggttttactctcatcttgccacatgactataaacaaaaagacatccctttttcattagagatccatctgttctgtgatttttttaccttgtgatttataaaaattaggacctaaatctataatataaacttcttggatgccagtcttactcatagctgacacattttagatcctactggaaaactaagaaatgcctcttatttcaataatccaaaacttaacatactcttagtaaattcttactttgctttattcacagaacacagaccaccagtgcaaaacaagaaaaagcaccaagtaaaaagccagtgaaaagaagaaaaaagaagagagctgccaattaaagctaacagttgtatatctgtatatataactattaaaagggatatttattcca

SEQ ID NO: 285740 - DNA, 1515 bp, Homo sapiens
tgatgacgtaattttcctgcgcctcggggcgagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaaggtttggcaaatacgtgtagacctacatttattaaatcatgatggaaatattattgatgctgccagcattgctgcaatcgtggccttatgtcatttccgaagacctgatgtctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagctttggagaatgaccaaaaagtaaggaaagaaggtggaaagtttggttttgcagagtctatagcaaatcaaaggatcacagcatttaaaatggaaaaggcccctattgatacctcggatgtagaagaaaaagcagaagaaatcattgctgaagcagaacctccttcagaagttgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaagaacacagaccaccagtgcaaaacaagaaaaagcaccaagtaaaaagccagtgaaaagaagaaaaaagaagagagctgccaattaaagctaacagttgtatatctgtatatataactattaaaagggatatttattccattctgagaaccctgggtattttttattcacaaatccattataaaatctagcaggattttaaaaatagttttttgtttttaatgtgctttaaaataataaaccttctggagca

SEQ ID NO: 285741 - DNA, 1653 bp, Homo sapiens
cgaccggcacgttcaccccatccctcaggctttatttattttttttcgacaggttcttttcaaggctccagtcaccgcagcagttgtccatgctgtagtttccactttcctgtatgggcgggctggttaggattccactttcccccaagtgcttagcccagggccagacaaaaagtagttgcttaagaaatacttgttgaaggaataaattaatgaatgaatttgtgcttacagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaaggtttggcaaatacgtgtagacctacatttattaaatcatgatggaaatattattgatgctgccagcattgctgcaatcgtggccttatgtcatttccgaagacctgatgtctctgtccaaggagatgaagtaacactgtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagctttggagaatgaccaaaaagtaaggaaagaaggtggaaagtttggttttgcagagtctatagcaaatcaaaggatcacagcatttaaaatggaaaaggcccctattgatacctcggatgtagaagaaaaagcagaagaaatcattgctgaagcagaacctccttcagaagttgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaagatgctcccataatactctcagatagtgaagaagaagaaatgatcattttggaaccagacaagaatccaaagaaaataagaacacagaccaccagtgcaaaacaagaaaaagcaccaagtaaaaagccagtgaaaagaagaaaaaagaagagagctgccaattaaagctaacagttgtatatctgtatatataactattaaaagggatatttattccattctgagaaccctgggtattttttattcacaaatccattataaaatctagcaggattttaaaaatagttttttgtttttaatgtgctttaaaataataaaccttctggagca

SEQ ID NO: 285742 - DNA, 1456 bp, Homo sapiens
tgatgacgtaattttcctgcgcctcggggcgagcagcggcgcgcaaggaaagatcgggttccgtttttcccgcggattctggtgcctgtggggccggtgacccaacaccatgaaggaaacgccactctcaaactgcgaacgccgcttcctactccgtgccatcgaagagaagaagcggctggatggcagacaaacctatgattataggaacatcaggatctcatttggaacagattacggatgctgcattgtggaacttggaaaaacaagagttcttggacaggtttcctgtgaacttgtgtctccaaaactcaatcgggcaacagaaggtattcttttttttaaccttgaactctctcagatggccgctccagctttcgaacctggcaggcagtcagatctcttggtgaagttgaatcgactcatggaaagatgtctaagaaattcgaagtgtatagacactgagtctctctgtgttgttgctggtgaaaagtatacacctgaagagcgtgatcctgtaccattaagtatccaccacatgcccatttgtgtcagttttgcctttttccagcaaggaacatatttattggtggatcccaatgaacgagaagaacgtgtgatggatggcttgctggtgattgccatgaacaaacatcgagagatttgtactatccagtccagtggtgggataatgctactaaaagatcaagttctgagatgcagtaaaatcgctggtgtgaaagtagcagaaattacagagctaatattgaaagctttggagaatgaccaaaaagtaaggaaagaaggtggaaagtttggttttgcagagtctatagcaaatcaaaggatcacagcatttaaaatggaaaaggcccctattgatacctcggatgtagaagaaaaagcagaagaaatcattgctgaagcagaacctccttcagaagttgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaagatgctcccataatactctcagatagtgaagaagaagaaatgatcattttggaaccagacaagaatccaaagaaaataagaacacagaccaccagtgcaaaacaagaaaaagcaccaagtaaaaagccagtgaaaagaagaaaaaagaagagagctgccaattaaagctaacagttgtatatctgtatatataactattaaaagggatatttattccattctgagaaccctgggtattttttattcacaaatccattataaaatctagcaggattttaaaaatagttttttgtttttaatgtgctttaaaataataaaccttctggagca

SEQ ID NO: 285743 - DNA, 1237 bp, Homo sapiens
aaacaatttctaaaatagatttgggggtaaggtctctatgccccttaagtctgtaattattagttgaatagtttttaaaattttaaatatactaacatgagtatattccggtatacctttctgtaggataatgtggtaacaaaaagcattaaaacagacatttttatttggtccagcaattcaaacttataggaatatacgctaaggaaataatcagacaaatgtacaaagttgtgtgttcaagcatgttcaatccaatagtttttataatagcaaaaaattggacactatttaataggggaatggccaaataaaccagggcagagagtcacacaatagtgtatattgaaaccataaaaataatagtgtaacataatgatgtaaaagatgttcatcacatactgctaagaaaagcaggttattaacattatgtttaggacagttcatttttgtaaaatcaaaaccaaaaccttacatatgtaagtaaaatctagaagaatatacactacagtaataatactaaagtattacccatgggaggtaggattataggttattttacttttcttttacctatatttttgaatttttctattaggatcatgaattactcctgttacaacaaacatccaaaaagcaataatgtggataaaatggtttctgtgagtaactgaaccagtaacttttcacagagtagtagaagcaatgaaaaatatacggttggatgagacatcttgttaacaaaaatccagatcgaatattcttcagctgggataactccacactgagactggtgttatatcttgcagcttgagcattgcttatggaaatagctatggcttcaggccatactgaaaaacctaacacaaaccataaactatttcctggatactgggagccaaatggaatgtaatttgggcttcttgggtagatccagctcctacctattcgagtattggcaaatacatcagctagagacccactggttcctttgacctctccgtgggacagcgtagaagatgcggatgaagaagtggacgatccctgaattgaacggttgatccaggactcagcattctgtaagctctgttgcaaggcagcagagagcgcagcttggcgtctcagagagccctcatcctcagaggccgaagatgtgtctgtgtggaattagaaaaaaagaagttctcgatcctacctagaacagagactttcagttcttgctcattgatcacacatt

SEQ ID NO: 285744 - DNA, 843 bp, Homo sapiens
cgtatacaggaggggcctgtgcatttggtagcttgggttcctccctgagcctgtgaaactcagatttgaactcatgtattttgggtgccatgactcttgtcgaggcagagtgaaagggcaagggcatggagctagatatccagggtgacaacaggctcccatggtgcctgagtgtgcattaaaaaaagcaccccttccacaagacattctccaaactgtcgaaccaaacccaccagcatcttcctacctgcccatgtgccggggtggggggaaaattagacatgtttgtctccccactacagatgtcggccaaaagatccaactggaaaatgcttgctactaccttccagtttcacgaccctctcagctaaggaagcccttcctgcatccatgtctctctatgcctgtctgtgaagtcccagctcacagctgacctggttaggtaagcactgttattttgtttcaacggagggaacctttggattacatgtacatagctagtcagtggcagcatttggttcatcacgctggttttaaaaactccattgccttttctcttcattagtcctatcatcttatgaagaaagtcaactcagtaaaaatatccgtcaaacaatggcttagggatatgcgtacagaacaatcaaatcagctgacagaatatctggcttttcacccagttataaaatgttgtgctttgcttaacatggtgaagaacgaaagctgctaacagctgatttctttctcccaaaatgtgagccctgctatgggagagcgcaaccagcagggggtgctggcgtctttccctgaacttcagggcacgcttgagagagggtacctggc

SEQ ID NO: 285745 - DNA, 1004 bp, Homo sapiens
  misc_feature (963)..(963): n is a, c, g, or t
cgtatacaggaggggcctgtgcatttggtagcttgggttcctccctgagcctgtgaaactcagatttgaactcatgtattttgggtgccatgactcttgtcgaggcagagtgaaagggcaagggcatggagctagatatccagggtgacaacaggctcccatggtgcctgagtgtgcattaaaaaaagcaccccttccacaagacattctccaaactgtcgaaccaaacccaccagcatcttcctacctgcccatgtgccggggtggggggaaaattagacatgtttgtctccccactacagatgtcggccaaaagatccaactggaaaatgcttgctactaccttccagtttcacgaccctctcagctaaggaagcccttcctgcatccatgtctctctatgcctgtctgtgaagtcccagctcacagctgacctggttaggaaatgcttactgacctctggtctaaacactgagaggtaagggacctctgctgcaccgccctggagggatttttgatccctaaataagaagaggtgaggaggaagcctgcccttcctcctggcctgaatgtgcttctgagaggcagtcaagcctggaactgtggcagccggcttgtgaccatgaagaaaccagcccaagaagaaaggccaacctgccaaggagggaacaggagcctggggcctcgaggactttgctgagccttcgtgtgaccctggagccaccttcctctggagttcttgtgatggcagataattcaatgttgtcattgttcaagccaggggtgggcgaactttttccataaagggccacatggaaaacattttaggctctgtgtgggccatgagatctctgttggcactacaaccctaaaaacaaccatagacaatgtgtaaatgaatgggtacacctatgttccaataaaactttacttataaaaataaacccgggttggccgaaagtngctctctctttatgatattacggcccgaaataaaaagacta

SEQ ID NO: 285746 - DNA, 602 bp, Homo sapiens
  misc_feature (561)..(561): n is a, c, g, or t
acctttccatactgtcgttggcctctctcgccagaagctggaaatgcttactgacctctggtctaaacactgagaggtaagggacctctgctgcaccgccctggagggatttttgatccctaaataagaagaggtgaggaggaagcctgcccttcctcctggcctgaatgtgcttctgagaggcagtcaagcctggaactgtggcagccggcttgtgaccatgaagaaaccagcccaagaagaaaggccaacctgccaaggagggaacaggagcctggggcctcgaggactttgctgagccttcgtgtgaccctggagccaccttcctctggagttcttgtgatggcagataattcaatgttgtcattgttcaagccaggggtgggcgaactttttccataaagggccacatggaaaacattttaggctctgtgtgggccatgagatctctgttggcactacaaccctaaaaacaaccatagacaatgtgtaaatgaatgggtacacctatgttccaataaaactttacttataaaaataaacccgggttggccgaaagtngctctctctttatgatattacggcccgaaataaaaagacta

SEQ ID NO: 285747 - DNA, 677 bp, Homo sapiens
  misc_feature (636)..(636): n is a, c, g, or t
tctctctctctctctctcacacacacacacacacacacacacacacacagaatatgctgcagagatcatatgtgacctgacaagcctaaaatactcactatctggtcctttataggaaatgcttactgacctctggtctaaacactgagaggtaagggacctctgctgcaccgccctggagggatttttgatccctaaataagaagaggtgaggaggaagcctgcccttcctcctggcctgaatgtgcttctgagaggcagtcaagcctggaactgtggcagccggcttgtgaccatgaagaaaccagcccaagaagaaaggccaacctgccaaggagggaacaggagcctggggcctcgaggactttgctgagccttcgtgtgaccctggagccaccttcctctggagttcttgtgatggcagataattcaatgttgtcattgttcaagccaggggtgggcgaactttttccataaagggccacatggaaaacattttaggctctgtgtgggccatgagatctctgttggcactacaaccctaaaaacaaccatagacaatgtgtaaatgaatgggtacacctatgttccaataaaactttacttataaaaataaacccgggttggccgaaagtngctctctctttatgatattacggcccgaaataaaaagacta

SEQ ID NO: 285748 - DNA, 568 bp, Homo sapiens
  misc_feature (527)..(527): n is a, c, g, or t
acctttccatactgtcgttggcctctctcgccagaagctggaaatgcttactgacctctggtctaaacactgagaggtaagggacctctgctgcaccgccctggagggatttttgatccctaaataagaagaggtgaggaggaagcctgaatgtgcttctgagaggcagtcaagcctggaactgtggcagccggcttgtgaccatgaagaaaccagcccaagaagagagggaacaggagcctggggcctcgaggactttgctgagccttcgtgtgaccctggagccaccttcctctggagttcttgtgatggcagataattcaatgttgtcattgttcaagccaggggtgggcgaactttttccataaagggccacatggaaaacattttaggctctgtgtgggccatgagatctctgttggcactacaaccctaaaaacaaccatagacaatgtgtaaatgaatgggtacacctatgttccaataaaactttacttataaaaataaacccgggttggccgaaagtngctctctctttatgatattacggcccgaaataaaaagacta

SEQ ID NO: 285749 - DNA, 428 bp, Homo sapiens
tgtgaccctggagccaccttcctctggagttcttgtgatggcagataattcaatgttgtcattgttcaagccaggggtgggcgaactttttccataaagggccacatggaaaacattttaggctctgtgtgggccatgagatctctgttggcactacaaccctaaaaacaaccatagacaatgtgtaaatgaatgggtacacctatgttccaataaaactttacttataaaaatagatggtgggctgaatttggccctgagggccagagtttgctgcgtattttgtttgtttgtttgttacttgcagctgacctatcctaactagtactccctgaagtctgcctcagctcagaagcgtccttgggttccaagccacaggggctaagcttgagtgtgggtggggtctgcagcagggtggtgggagggat

SEQ ID NO: 285750 - DNA, 800 bp, Homo sapiens
tcctgatgttgaatttcctcatggtctcggaggggctcccccgcagcccgggaggggaggcacagggggtccccgggcgggggagaccacccggggccgaaggcagcttcgaccgcggaaacggaggagtgggagtgtgaggagaaatatgcaatgatgacatttccaagaagtgatggcatctggcgctaaggacaaagaatgggattttgccacagggatcttattctcccacatgttctgtctgaaggagaaagttatctgaggccttatatgatgcaaaactttggactcaaagaaattaaatcacttgcccaaggttacatagctgcccctggcaaacaccattctactttccgtctctatgaatttgactactcgaagtacctcatgtgaaatgttggtgccaaatgaacttttctggttcttctgaatatgccactgttgctggagaaatgtcactgctagagaacagaagactattattccaaagggtatttgagactgactgaatcaggtctggaacattattgaaatgagacccacaaaagaagagatactgaggtggtgaccagatggatataaacgggctgtggaaaaagagaatgcatggccaaaaatggtggtgctctctgtccaaaaactgaggccctatgaccatgaatgaagccagagggcaggtaggaatagatcatttgctccagaagaagctggttgccatgtcttgaggacagtaaaccctctggggaggttcctgtggtaaggaacaagggctcctggcaatagcctctgagtgagcc

SEQ ID NO: 285751 - DNA, 649 bp, Homo sapiens
acttcattgcataatgcagtagccactggatttgcagcagaaacactctgctacagaacaagtgtcttggttcacagcaaagaggacaaagaaaacagcaagttttagggggttgaatcctggattcccctggcaaacaccattctactttccgtctctatgaatttgactactcgaagtacctcatgtgaaatgttggtgccaaatgaacttttctggttcttctgaatatgccactgttgctggagaaatgtcactgctagagaacagaagactattattccaaagggtatttgagactgactgaatcaggtctggaacattattgaaatgagacccacaaaagaagagatactgagtaattcagcatttccagtgacatccttctggctgtgcttcaaagggaagatgacgctagagctggcagcatgaccagcactgtgtaaatcacccagacagacaacaacacaacatccatgaatagatggcagagttagcaagaaaaaatagcttggaggatggaaaaaccccaaaggatactccagctaagaaagtatggacgcttcccctagtttagaatgcacttcagatggattccaagctagaacaaggtctatctggaggtgaagtcatgtgacatgaactaatg

SEQ ID NO: 285752 - DNA, 942 bp, Homo sapiens
aggacgatgtcttgcatttggaacctacaaaattttgatttgtcgtttaatatttattgaattagttgattcgctgggtgcaacgaccaagaaaacaaatagaaatatgcaatgatgacatttccaagaagtgatggcatctggcgctaaggacaaagaatgggattttgccacagggatcttattctcccacatgttctgtctgaaggagaaagttatctgaggccttatatgatgcaaaactttggactcaaagaaattaaatcacttgcccaaggttacatagctgccacccaggagcttacaatttatgtgaggaaacagattgtatacatatacagataattaaaaatatatatgcccctggcaaacaccattctactttccgtctctatgaatttgactactcgaagtacctcatgtgaaatgttggtgccaaatgaacttttctggttcttctgaatatgccactgttgctggagaaatgtcactgctagagaacagaagactattattccaaagggtatttgagactgactgaatcaggtctggaacattattgaaatgagacccacaaaagaagagatactgagtgtaactggatcttggttcatgctgagcttaaaatttgatcttctgaatatcagcagaaagactctttctggtgaatacagatcttctgagcaattatcgactgactttgtcattagactgccctttcagaagttgtcagtgacatgaatctttgctcccttcttcatggaatatttctggtctaatagcccctatatttcaaaagatggatataaacatcagatgaatatcacaggaaagctggattgctctgcagtgagtgaaacgtggaaaggcctttccccaccaagcagtaggccaaattgtaacagtaagatgtatttgaaataaaatggttcatagatcaaa

SEQ ID NO: 285753 - DNA, 1270 bp, Homo sapiens
aggacgatgtcttgcatttggaacctacaaaattttgatttgtcgtttaatatttattgaattagttgattcgctgggtgcaacgaccaagaaaacaaatagaaatatgcaatgatgacatttccaagaagtgatggcatctggcgctaaggacaaagaatgggattttgccacagggatcttattctcccacatgttctgtctgaaggagaaagttatctgaggccttatatgatgcaaaactttggactcaaagaaattaaatcacttgcccaaggttacatagctgccacccaggagcttacaatttatgtgaggaaacagattgtatacatatacagataattaaaaatatatatgcccctggcaaacaccattctactttccgtctctatgaatttgactactcgaagtacctcatgtgaaatgttggtgccaaatgaacttttctggttcttctgaatatgccactgttgctggagaaatgtcactgctagagaacagaagactattattccaaagggtatttgagactgactgaatcaggtctggaacattattgaaatgtaattcagcatttccagtgacatccttctggctgtgcttcaaagggaagatgacgctagagctggcagcatgaccagcactgtgtaaatcacccagacagacaacaacacaacatccatgaatagatggcagagttagcaagaaaaaatagcttggaggatggaaaaaccccaaaggtgtgaaatctctggctttttttccattttatttagctttgcttatcattatttttcttttctttcctacccatttgcctttatgttctaagatgtagtaggaatctttagtagtgatggatcataatttttgagtccacaagcagacattatctgatttaataaaaaaattggaaaggtggaccttacccatttagaacaacttcttattagcaaatcaaaactctgagcaagagtcttagagcagggcctataaaatgagaagggccatgtattagagagttagctcagacctccagagtcagcctcacctacacttctgacttaggccaggctacaggtaagcaggataaacaggaacatctagttctttgttttgtatcataaactacttggataggaagttgtcttgttagaacatgccccatgtttccatcatcttgtcttaatattgattacacccaacaaaaaagacaatagcactcacaagttttcagcataatagagaaaatgtggtgtcaccattg

SEQ ID NO: 285754 - DNA, 722 bp, Homo sapiens
ggtccaaacatgaaagaattcccaacatcaagattgattgaaacatattcaatgggatgtaggctggtggcagaaagtagaccctggagaacaggagcacttggtttcaaataaaatacctgcattaaatattcagctttcctgcacctttatcattacatttgatttgcaaagaagatagaagtcttaagtcactgtacaaagagaaagatataaaagtttaaaaagatacaatgactttcccatagctaacaaggagccagcatgggtccaagttttggcatcgatttggggaaaatgctttcaaactctaaaatcttataaagatggggaaaataattactaataaaggcctactacggccttttatatgtgtaactggatcttggttcatgctgagcttaaaatttgatcttctgaatatcagcagaaagactctttctggtgaatacagatcttctgagcaattatcgactgactttgtcattagactgccctttcagaagttgtcagtgacatgaatctttgctcccttcttcatggaatatttctggtctaatagcccctatatttcaaaagatggatataaacatcagatgaatatcacaggaaagctggattgctctgcagtgagtgaaacgtggaaaggcctttccccaccaagcagtaggccaaattgtaacagtaagatgtatttgaaataaaatggttcatagatcaaa

SEQ ID NO: 285755 - DNA, 569 bp, Homo sapiens
acttcattgcataatgcagtagccactggatttgcagcagaaacactctgctacagaacaagtgtcttggttcacagcaaagaggacaaagaaaacagcaagttttagggggttgaatcctggattcccctggcaaacaccattctactttccgtctctatgaatttgactactcgaagtacctcatgtgaaatgttggtgccaaatgaacttttctggttcttctgaatatgccactgttgctggagaaatgtcactgctagagaacagaagactattattccaaagggtatttgagactgactgaatcaggtctggaacattattgaaatggtggtgaccagatggatataaacgggctgtggaaaaagagaatgcatggccaaaaatggtggtgctctctgtccaaaaactgaggccctatgaccatgaatgaagccagagggcaggtaggaatagatcatttgctccagaagaagctggttgccatgtcttgaggacagtaaaccctctggggaggttcctgtggtaaggaacaagggctcctggcaatagcctctgagtgagcc

SEQ ID NO: 285756 - DNA, 854 bp, Homo sapiens
gcgcgcacactgcgctccttcccctggcaggtgggcggcggggcgagcggagaggcccgcggggctcgcggagtccaggggcagacgggatgggtctccgtgctgaaacccccggcgctcctgccacactgtgaggcatcctgtgtgtgtgaagcacccgccgtcagtcaagtatgcctggtgctttctctcagaactcatcaaaaagcacgaggctgtccacacggagcctttggatgagctgtacgaggcgctggcggagaccctgatggccaaggagtccccccagggccaccggagctatttgttgccctcgggaggctcggtcacactctccgaaagcatggccatcatctcccacagcaccacgggtctggtcacatgggatgccgccctctacattgcagaatgggccatcgagaacccggcagccttcactcacagatgtgctgtattgcccagaagccattgtgtcactggtcagggtcctgcggaggctggctgcctgccgggagcaccagcgggcttctgaggtctacgtggccttcgctgtccgcaattgagagacgtgccagctgttcaccaccgagctaggccctttgccttcacagagaagagcagacactgccatggacccgtctctgtccctgccacatggccccaggcccaagacactccccctaggagggatccttttcccagaagctccacccctcggcagctccagtcaggccccatctgggcccttccagaagcaacccaggagcccgagacctgcaggggtgtgtgcaccctgacccctgatgcatagccctgcacctgcagccagctggcctcgggctgcaaacatggtg

SEQ ID NO: 285757 - DNA, 462 bp, Homo sapiens
ttgcttcggtcttttgcagctttctctactaagggttctcctttttcacccaagtaattgcctttccatctaatggctcaaatggtcaaaaggcatctaatagtctcatatgatcgctgcctctctggcctcgccctgctgctgaggtcagcgtgacctggaactgtccgctggtccctttcagtaacctgaagctttcaccgtagatgtgctgtattgcccagaagccattgtgtcactggtcagggtcctgcggaggctggctgcctgccgggagcaccagcgggcttctgaggtctacgtggccttcgctgtccgcaactagaagcgggggtagtcctcggccctccagccagtgggtgcagacctggatgtgctggaaatgcttctggtggatgaggcggctgtaatactccctcagaggccctgttatcacacagacaagagaaggaaggttgcgtc

SEQ ID NO: 285758 - DNA, 736 bp, Homo sapiens
tggtgcagtcgcagacacggtcccctttcctctcgccaggtctgtcttagagcttggcagtggtgccagcctcacaggcctggccatctgcaagatatgccgcccccgggcatacatcttcagcgactgtcacagccgagtcctcgagcagctccaaggaaatgtccttctcaatggcctctcattagaggcagacatcactgccaacttagacagccctagggtgacaatggcccagcgctggactgggacgtagtgacggtccatcagcgctctgccttccagctagatgttgtcattgcagcaggtaatgcccagccctgagcaccctgtgcaggcactgtccttgcagctctacccagctcttggctctagaagcgggggtagtcctcggccctccagccagtgggtgcagacctggatgtgctggaaatgcttctggtggatgaggcggctgtaatactccctcagaggccgccctttgccttcacagagaagagcagacactgccatggacccgtctctgtccctgccacatggccccaggcccaagacactccccctaggagggatccttttcccagaagctccacccctcggcagctccagtcaggccccatctgggcccttccagaagcaacccaggagcccgagacctgcaggggtgtgtgcaccctgacccctgatgcatagccctgcacctgcagccagctggcctcgggctgcaaacatggtg

SEQ ID NO: 285759 - DNA, 600 bp, Homo sapiens
agatttaagagacaaaattttttatttttatttttaccaaagcgggtgagtgagtagagttcagtaagaggttagaagagcgtgagggctgggaacagcaggggaggggaataggagataatctgagtagcaatgtgtaaatgtgactgtcttaggctcagcaatattgcgtagtcgcacgtggaagtcccgactgaagttggacacttttcgttcgcagtggtgccaattctcagggttgtgtgattttctgcaccgatgcaggagtgagcaaggttggttgaactgttgcagactaacagttttgcaggtgggcgaaggatcagggaggaaattgagttgagggtgttggtgaataggatataggagtttcagaacccgactacacatctgtcgttgatggtctaaatatttgcatgtttgcaggtccagcgatggcacaatgcctagcagcagaaggtttgcacccactgtgcgacatgagtggcagctagtaagtttacacattgaggatacaatggcgaaacggggccgcgaggcgatgacgtcattcgcgggagtaggggggagaagcgaccactgttagggtactgtccataa

SEQ ID NO: 285760 - DNA, 570 bp, Homo sapiens
agatttaagagacaaaattttttatttttatttttaccaaagcgggtgagtgagtagagttcagtaagaggttagaagagcgtgagggctgggaacagcaggggaggggaataggagataatctgagtagcaatgtgtaaatgtgactgtcttaggctcagcaatattgcgtagtcgcacgtggaagtcccgactgaagttggacacttttcgttcgcagtggtgccaattctcagggttgtgtgattttctgcaccgatgcaggagtgagcaaggtccagcgatggcacaatgcctagcagcagaaggtttgcacccactgtgcgacatgagtggcagctctggaaaatcataaaatcatgggaggacttgagagtgcaggctgggtggggtgggactgtggctgcgaaaaacagtgttatgaaactgtgcgcgggacaagaaagctgattttactgattgtatattggggagtactacgggaatcactggagaggccacttcattttctcctatcccaccccatcttttggggttgcaactaacctttgaggtggtaacaaacgactg

SEQ ID NO: 285761 - DNA, 2207 bp, Homo sapiens
gagaaatggcgacggagcctggctgtgggcccatctttggaaaaaagatctgggaatgattgtctagcctccagcctcaacttacttgatgcttgagagactcaaagccccgcagtctactttgccatccctgccaaggaggacactgaaggcctggcccagatgttccaagtattcaagaagtttaatccagcatgggagagagtctgtaccatcctggtggatcctcatttccttccactgcctatcctagctatggagttccccacagctgaggtccttctctcagccttccacatttgtaagttcctccaggccaagttctatcagctgtcccttgaacggcccgtggaaaggctgctcctgacctccctgcagagcacaatgtgctcagccacagcaggcaacctgagaaagttgtatacactcctgagcaactgcatccctccagccaagctgcccgagcttcactcacactggctgctcaacgaccgcatctggctggctcaccgctggagaagccgagctgagagcagccactacttccagagcctcgaggtcaccacccacatcctcagccagttctttggtaccaccccatctgagaaacaaggtatggcttctctgttccgttacatgcagcagaactctgcagacaaggcaaacttcaaccagggcctgtgtgcccagaacaatcatgctccctcagacaccatccccgaaagccccaaactggagcagctggtagaatcccacatccagcactccctcaatgccatctgcacagggccagcagcccaactgtgcctgggcgagcttgctgtggtccagaaatccacacacctcattggctctggctcagaaaagatgaacatacagatcctggaagatacccataaggtgcagccccagccccctgccagctgcagctgctactttaaccaggccttccacctgccctgccgccacatcctagccatgctcagtgcccgccgccaggtgctccagcccgacatgctgccggctcagtggacggcaggctgtgctaccagtctagacagcatcctgggcagcaagtggagtgagaccctggataagcacctggcagtgactcacctcaccgaggaggtgggtcagctgttgcagcactgcaccaaggaggagtttgagcggaggtatagcacccttgcgggaactggccgacagctggattgggccttatgagcaggtccaactctgattattctcgatgcccagagatgctcatgcacctgtgcacactcacatccacccatacacacacacacacacacacacacacacacacacactcccttacactgttgtacttccgtgggccctccttccagaacaaggacaacaaggacaaggttgaagggtcttctcatctaccatggcctgctacctagcatgtgtctagctcaatgagacaggagtcagcaatcttaatctgtttagtttactctggtggaactccgagtctgtcacctacttctggcagaactggaacatccctgtgcacaagtggtgcatcaggtaggtggggtgtgtgtgtgtgtgatgtggaacatggctgtgaacctgaaccgctttccatgccccctcctctgcagacaacacttctacaagcccatgcttcgacggggcagcagcaagtggatggccaggacaggggtgttcctggcctcggccttcttccacgagtacctggtgagcgtccctctgcgaatgttccgcctctgggcgttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggcctggcttctcactgccacctcacacccgctgccagagcccacctctcctcctaggcctcgagtgctggggatgggcctggctgcacagcatcctcctctggtcccagggaggcctctctgcccctatggggctctgtcctgcacccctcagggatggcgacagcaggccagacacagtctgatgccagctgggagtcttgctgaccctgccccgggtccgagggtgtcaataaagtgctgtccagtga

SEQ ID NO: 285762 - DNA, 1087 bp, Homo sapiens
  misc_feature (37)..(38): n is a, c, g, or t
  misc_feature (46)..(46): n is a, c, g, or t
cactaatcaacccaaatacggctaagtagaggcgcgnnttatcggncgaggccacaagggcgagtgccagagctgtgtggacagctgtccaggacctgccggggagcagcagctccactgcagcagggcgggcatggccggtagggggagtgcaaggccaggcagacgcccccattccccacactcccctacctagaaaagctcagctcaggcgtcctctcctggtgctactcctgctgggtgtgcgggaatcggcactctggccctcagtgcaggatggtcaacttgcacccaccgtgctcagcttcagcttgggaagaggtcggccctgggtttgcgggaagtgggctccagccaggatggcccagggatgggcagtccacagggcctttctggtgtgggtctggtgagccgaggggctacggtacacaatggctatgtccatggctattcgccttggggcagggctcggtttggcagcctctttccttcacttggaacctgggcagccaggtgggctggtggctctcagctgccctccacgaggttggggcacccctgatccccaggcctgccttgccctctgctcttctggcaccaggctgggcagtgcagacagcgcagccctgcagccttcaggacaccttgttcccaggccctgcaatccaccaagctggatagatggggccccccttgatggtagcgggaggtcaggggtaaccccagggccctgctgctgccttaccttgctggggtgactgcttgattaaagaccccaagactggaccaggccctggtgtccccagacctgcagctatggcccaacaaggcaggtgtttgaggaggccctgcacagggtcccaggactgcaccagggcctcatcagcaacctgctgaactggtggtgtgaggggagggtgggctcccttggtggtatcctccctctaccccagtgggggctggtgggccctgagatggaggcatctccttgggcctgctgaggatggcagtagtgggtgagctcctggtggggggatgggtgtggggccgactcctccatcccacatgggctcctgtgcctctccct

SEQ ID NO: 285763 - DNA, 453 bp, Homo sapiens
ccactgcccagcgcaggcccccttcccttcctccaccaggctgagtggagaaccctaaagctacgggacaggctcccgttccccgtgcctacacagggtgctggctctggcagaaagacagtgtgcccgccccgcatcacctgtccgagtgcgaacaccttgggaagggggttcctggtggtcctgtgacaaccagagacccccagggccaaggaggccactgcagcccggcccttctgtgccctgggcccctcctcattgcagcaccacccaccgcaccaccctgggacagaggaaacacatggaggccatagcatagagcctgtctgtttatagatctctgcctgtcttgtccgtccatccactgtgtgtatatatctgtgtatctctgtggagcggggaacgggacagttgtgtaaaaatccaaaatacaattctgactatgaacaacct

SEQ ID NO: 285764 - DNA, 3084 bp, Homo sapiens
cgcctcaggtcggccgcggactacaaatggacgagagaggcggccgtccattagttagcggctccggagcaacgcagccgttgtccttgaggccgacgggcccgacgcgggcgggttgaacgcgctggtgaggcggtcacccgggctacggcggccggcagggggcagtggcggccgttgtctagggcccggaggtggggccgcgcgcctcgggcgctacgaacccggcgggcccacgcttggctgcggccgggtgcgggctgaggccatgggcgaccgcggcagctcccggcgccggaggacagggtcgcggccctcgagccacggcggcggcgggcctgcggcggcggaagaggaggtgcgggacgccgctgcgggccccgacgtgggagccgcgggggacgcgccagccccggcccccaacaaggacggagacgccggcgtgggcagcggccactgggagctgaggtgccatcgcctgcaggattctttattcagctctgacagtggcttcagcaactaccgtggcatcctgaactggtgtgtggtgatgctgatcttgagcaatgcccggttatttctggagaacctcatcaagtatggcatcctggtggaccccatccaggtggtttctctgttcctgaaggatccctatagctggcccgccccatgcctggttattgcggccaatgtctttgctgtggctgcattccaggttgagaagcgcctggcggtgggtgccctgacggagcaggcgggactgctgctgcacgtggccaacctggccaccattctgtgtttcccagcggctgtggtcttactggttgagtctatcactccagtgggctccctgctggcgctgatggcgcacaccatcctcttcctcaagctcttctcctaccgcgacgtcaactcatggtgccgcagggccagggccaaggctgcctctgcagggaagaaggccagcagtgctgctgccccgcacaccgtgagctacccggacaatctgacctaccgcgatctctactacttcctcttcgcccccaccttgtgctacgagctcaactttccccgctctccccgcatccggaagcgctttctgctgcgacggatccttgagatgctgttcttcacccagctccaggtggggctgatccagcagtggatggtccccaccatccagaactccatgaagcccttcaaggacatggactactcacgcatcatcgagcgcctcctgaagctggcggtccccaatcacctcatctggctcatcttcttctactggctcttccactcctgcctgaatgccgtggctgagctcatgcagtttggagaccgggagttctaccgggactggtggaactccgagtctgtcacctacttctggcagaactggaacatccctgtgcacaagtggtgcatcagacacttctacaagcccatgcttcgacggggcagcagcaagtggatggccaggacaggggtgttcctggcctcggccttcttccacgagtacctggtgagcgtccctctgcgaatgttccgcctctgggcgttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggcctggcttctcactgccacctcacacccgctgccagagcccacctctcctcctaggcctcgagtgctggggatgggcctggctgcacagcatcctcctctggtcccagggaggcctctctgcccctatggggctctgtcctgcacccctcagggatggcgacagcaggccagacacagtctgatgccagctgggagtcttgctgaccctgccccgggtccgagggtgtcaataaagtgctgtccagtgacctcttcagcctgccaggggcctggggcctggtggggggtatggccacacccacaagggcgagtgccagagctgtgtggacagctgtccaggacctgccggggagcagcagctccactgcagcagggcgggcatggccggtagggggagtgcaaggccaggcagacgcccccattccccacactcccctacctagaaaagctcagctcaggcgtcctctcctggtgctactcctgctgggtgtgcgggaatcggcactctggccctcagtgcaggatggtcaacttgcacccaccgtgctcagcttcagcttgggaagaggtcggccctgggtttgcgggaagtgggctccagccaggatggcccagggatgggcagtccacagggcctttctggtgtgggtctggtgagccgaggggctacggtacacaatggctatgtccatggctattcgccttggggcagggctcggtttggcagcctctttccttcacttggaacctgggcagccaggtgggctggtggctctcagctgccctccacgaggttggggcacccctgatccccaggcctgccttgccctctgctcttctggcaccaggctgggcagtgcagacagcgcagccctgcagccttcaggacaccttgttcccaggccctgcaatccaccaagctggatagatggggccccccttgatggtagcgggaggtcaggggtaaccccagggccctgctgctgccttaccttgctggggtgactgcttgattaaagaccccaagactggaccaggccctggtgtccccagacctgcagctatggcccaacaaggcaggtgtttgaggaggccctgcacagggtcccaggactgcaccagggcctcatcagcaacctgctgaactggtggtgtgaggggagggtgggctcccttggtggtatcctccctctaccccagtgggggctggtgggccctgagatggaggcatctccttgggcctgctgaggatggcagtagtgggtgagctcctggtggggggatgggtgtggggccgactcctccatcccacatgggctcctgtgcctctccct

SEQ ID NO: 285765 - DNA, 2078 bp, Homo sapiens
cgcctcaggtcggccgcggactacaaatggacgagagaggcggccgtccattagttagcggctccggagcaacgcagccgttgtccttgaggccgacgggcccgacgcgggcgggttgaacgcgctggtgaggcggtcacccgggctacggcggccggcagggggcagtggcggccgttgtctagggcccggaggtggggccgcgcgcctcgggcgctacgaacccggcgggcccacgcttggctgcggccgggtgcgggctgaggccatgggcgaccgcggcagctcccggcgccggaggacagggtcgcggccctcgagccacggcggcggcgggcctgcggcggcggaagaggaggtgcgggacgccgctgcgggccccgacgtgggagccgcgggggacgcgccagccccggcccccaacaaggacggagacgccggcgtgggcagcggccactgggagctgaggtgccatcgcctgcaggattctttattcagctctgacagtggcttcagcaactaccgtggcatcctgaactggtgtgtggtgatgctgatcttgagcaatgcccggttatttctggagaacctcatcaagtatggcatcctggtggaccccatccaggtggtttctctgttcctgaaggatccctatagctggcccgccccatgcctggttattgcggccaatgtctttgctgtggctgcattccaggttgagaagcgcctggcggtgggtgccctgacggagcaggcgggactgctgctgcacgtggccaacctggccaccattctgtgtttcccagcggctgtggtcttactggttgagtctatcactccagtgggctccctgctggcgctgatggcgcacaccatcctcttcctcaagctcttctcctaccgcgacgtcaactcatggtgccgcagggccagggccaaggctgcctctgcagggaagaaggccagcagtgctgctgccccgcacaccgtgagctacccggacaatctgacctaccgcgatctctactacttcctcttcgcccccaccttgtgctacgagctcaactttccccgctctccccgcatccggaagcgctttctgctgcgacggatccttgagatgctgttcttcacccagctccaggtggggctgatccagcagtggatggtccccaccatccagaactccatgaagcccttcaaggacatggactactcacgcatcatcgagcgcctcctgaagctggcggtccccaatcacctcatctggctcatcttcttctactggctcttccactcctgcctgaatgccgtggctgagctcatgcagtttggagaccgggagttctaccgggactggtggaactccgagtctgtcacctacttctggcagaactggaacatccctgtgcacaagtggtgcatcaggtaggtggggtgtgtgtgtgtgtgatgtggaacatggctgtgaacctgaaccgctttccatgccccctcctctgcagacaacacttctacaagcccatgcttcgacggggcagcagcaagtggatggccaggacaggggtgttcctggcctcggccttcttccacgagtacctggtgagcgtccctctgcgaatgttccgcctctgggcgttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggcctggcttctcactgccacctcacacccgctgccagagcccacctctcctcctaggcctcgagtgctggggatgggcctggctgcacagcatcctcctctggtcccagggaggcctctctgcccctatggggctctgtcctgcacccctcagggatggcgacagcaggccagacacagtctgatgccagctgggagtcttgctgaccctgccccgggtccgagggtgtcaataaagtgctgtccagtga

SEQ ID NO: 285766 - DNA, 2096 bp, Homo sapiens
cgcctcaggtcggccgcggactacaaatggacgagagaggcggccgtccattagttagcggctccggagcaacgcagccgttgtccttgaggccgacgggcccgacgcgggcgggttgaacgcgctggtgaggcggtcacccgggctacggcggccggcagggggcagtggcggccgttgtctagggcccggaggtggggccgcgcgcctcgggcgctacgaacccggcgggcccacgcttggctgcggccgggtgcgggctgaggccatgggcgaccgcggcagctcccggcgccggaggacagggtcgcggccctcgagccacggcggcggcgggcctgcggcggcggaagaggaggtgcgggacgccgctgcgggccccgacgtgggagccgcgggggacgcgccagccccggcccccaacaaggacggagacgccggcgtgggcagcggccactgggagctgaggtgccatcgcctgcaggattctttattcagctctgacagtggcttcagcaactaccgtggcatcctgaactggtgtgtggtgatgctgatcttgagcaatgcccggttatttctggagaacctcatcaagtatggcatcctggtggaccccatccaggtggtttctctgttcctgaaggatccctatagctggcccgccccatgcctggttattgcggccaatgtctttgctgtggctgcattccaggttgagaagcgcctggcggtgggtgccctgacggagcaggcgggactgctgctgcacgtggccaacctggccaccattctgtgtttcccagcggctgtggtcttactggttgagtctatcactccagtgggctccctgctggcgctgatggcgcacaccatcctcttcctcaagctcttctcctaccgcgacgtcaactcatggtgccgcagggccagggccaaggctgcctctgcagggaagaaggccagcagtgctgctgccccgcacaccgtgagctacccggacaatctgacctaccgcgatctctactacttcctcttcgcccccaccttgtgctacgagctcaactttccccgctctccccgcatccggaagcgctttctgctgcgacggatccttgagatgctgttcttcacccagctccaggtggggctgatccagcagtggatggtccccaccatccagaactccatgaagcccttcaaggacatggactactcacgcatcatcgagcgcctcctgaagctggcggtgagtgcggacaggtggcgcatgcacaggacaggaggggacagtggcatgtgggggaaggttctagaacttggtgcccacccccacctccctgccaggtccccaatcacctcatctggctcatcttcttctactggctcttccactcctgcctgaatgccgtggctgagctcatgcagtttggagaccgggagttctaccgggactggtggaactccgagtctgtcacctacttctggcagaactggaacatccctgtgcacaagtggtgcatcagacacttctacaagcccatgcttcgacggggcagcagcaagtggatggccaggacaggggtgttcctggcctcggccttcttccacgagtacctggtgagcgtccctctgcgaatgttccgcctctgggcgttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggcctggcttctcactgccacctcacacccgctgccagagcccacctctcctcctaggcctcgagtgctggggatgggcctggctgcacagcatcctcctctggtcccagggaggcctctctgcccctatggggctctgtcctgcacccctcagggatggcgacagcaggccagacacagtctgatgccagctgggagtcttgctgaccctgccccgggtccgagggtgtcaataaagtgctgtccagtga

SEQ ID NO: 285767 - DNA, 2006 bp, Homo sapiens
  misc_feature (2003)..(2003): n is a, c, g, or t
cgcctcaggtcggccgcggactacaaatggacgagagaggcggccgtccattagttagcggctccggagcaacgcagccgttgtccttgaggccgacgggcccgacgcgggcgggttgaacgcgctggtgaggcggtcacccgggctacggcggccggcagggggcagtggcggccgttgtctagggcccggaggtggggccgcgcgcctcgggcgctacgaacccggcgggcccacgcttggctgcggccgggtgcgggctgaggccatgggcgaccgcggcagctcccggcgccggaggacagggtcgcggccctcgagccacggcggcggcgggcctgcggcggcggaagaggaggtgcgggacgccgctgcgggccccgacgtgggagccgcgggggacgcgccagccccggcccccaacaaggacggagacgccggcgtgggcagcggccactgggagctgaggtgccatcgcctgcaggattctttattcagctctgacagtggcttcagcaactaccgtggcatcctgaactggtgtgtggtgatgctgatcttgagcaatgcccggttatttctggagaacctcatcaagtatggcatcctggtggaccccatccaggtggtttctctgttcctgaaggatccctatagctggcccgccccatgcctggttattgcggccaatgtctttgctgtggctgcattccaggttgagaagcgcctggcggtgggtgccctgacggagcaggcgggactgctgctgcacgtggccaacctggccaccattctgtgtttcccagcggctgtggtcttactggttgagtctatcactccagtgggctccctgctggcgctgatggcgcacaccatcctcttcctcaagctcttctcctaccgcgacgtcaactcatggtgccgcagggccagggccaaggctgcctctgcagggaagaaggccagcagtgctgctgccccgcacaccgtgagctacccggacaatctgacctaccgcgatctctactacttcctcttcgcccccaccttgtgctacgagctcaactttccccgctctccccgcatccggaagcgctttctgctgcgacggatccttgagatgctgttcttcacccagctccaggtggggctgatccagcagtggatggtccccaccatccagaactccatgaagcccttcaaggacatggactactcacgcatcatcgagcgcctcctgaagctggcggtccccaatcacctcatctggctcatcttcttctactggctcttccactcctgcctgaatgccgtggctgagctcatgcagtttggagaccgggagttctaccgggactggtggaactccgagtctgtcacctacttctggcagaactggaacatccctgtgcacaagtggtgcatcagacacttctacaagcccatgcttcgacggggcagcagcaagtggatggccaggacaggggtgttcctggcctcggccttcttccacgagtacctggtgagcgtccctctgcgaatgttccgcctctgggcgttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggctggtttaatgacttaaaccgtgcagaggcaacttctctaagctgagtgtgggatggctggtgaagtctcttgggtcaggaagtttggcttggggtggtggccctaggtggggagggggaaattgttgcggggagtttgacaggccgggaggttaagggggggtttaaagaaacataagaaaggggggtgatagcgggagacttatgggaggataagggagagaggtgtcgtgataaatattgtattgtagtgngaa

SEQ ID NO: 285768 - DNA, 1514 bp, Homo sapiens
cgcctcaggtcggccgcggactacaaatggacgagagaggcggccgtccattagttagcggctccggagcaacgcagccgttgtccttgaggccgacgggcccgacgcgggcgggttgaacgcgctggtgaggcggtcacccgggctacggcggccggcagggggcagtggcggccgttgtctagggcccggaggtggggccgcgcgcctcgggcgctacgaacccggcgggcccacgcttggctgcggccgggtgcgggctgaggccatgggcgaccgcggcagctcccggcgccggaggacagggtcgcggccctcgagccacggcggcggcgggcctgcggcggcggaagaggaggtgcgggacgccgctgcgggccccgacgtgggagccgcgggggacgcgccagccccggcccccaacaaggacggagacgccggcgtgggcagcggccactgggagctgaggtgccatcgcctgcaggattctttattcagctctgacagtggcttcagcaactaccgtggcatcctgaactggtgtgtggtgatgctgatcttgagcaatgcccggttatttctggagaacctcatcaagtatggcatcctggtggaccccatccaggtggtttctctgttcctgaaggatccctatagctggcccgccccatgcctggttattgcggccaatgtctttgctgtggctgcattccaggttgagaagcgcctggcggtgggtgccctgacggagcaggcgggactgctgctgcacgtggccaacctggccaccattctgtgtttcccagcggctgtggtcttactggttgagtctatcactccagtgggctccctgctggcgctgatggcgcacaccatcctcttcctcaagctcttctcctaccgcgacgtcaactcatggtgccgcagggccagggccaaggctgacacttctacaagcccatgcttcgacggggcagcagcaagtggatggccaggacaggggtgttcctggcctcggccttcttccacgagtacctggtgagcgtccctctgcgaatgttccgcctctgggcgttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggcctggcttctcactgccacctcacacccgctgccagagcccacctctcctcctaggcctcgagtgctggggatgggcctggctgcacagcatcctcctctggtcccagggaggcctctctgcccctatggggctctgtcctgcacccctcagggatggcgacagcaggccagacacagtctgatgccagctgggagtcttgctgaccctgccccgggtccgagggtgtcaataaagtgctgtccagtga

SEQ ID NO: 285769 - DNA, 1017 bp, Homo sapiens
gggagtgaccaggagcatggctagctgaagggcttgtttctgcaggacatggactactcacgcatcatcgagcgcctcctgaagctggcggtgagtgcggacaggtggcgcatgcacaggacaggaggggacagtggcatgtgggggaaggttctagaacttggtgcccacccccacctccctgccaggtccccaatcacctcatctggctcatcttcttctactggctcttccactcctgcctgaatgccgtggctgagctcatgcagtttggagaccgggagttctaccgggactggtggaactccgagtctgtcacctacttctggcagaactggaacatccctgtgcacaagtggtgcatcaggtaggtggggtgtgtgtgtgtgtgatgtggaacatggctgtgaacctgaaccgctttccatgccccctcctctgcagacaacacttctacaagcccatgcttcgacggggcagcagcaagtggatggccaggacaggggtgttcctggcctcggccttcttccacgagtacctggtgagcgtccctctgcgaatgttccgcctctgggcgttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggcctggcttctcactgccacctcacacccgctgccagagcccacctctcctcctaggcctcgagtgctggggatgggcctggctgcacagcatcctcctctggtcccagggaggcctctctgcccctatggggctctgtcctgcacccctcagggatggcgacagcaggccagacacagtctgatgccagctgggagtcttgctgaccctgccccgggtccgagggtgtcaataaagtgctgtccagtga

SEQ ID NO: 285770 - DNA, 1998 bp, Homo sapiens
cgcctcaggtcggccgcggactacaaatggacgagagaggcggccgtccattagttagcggctccggagcaacgcagccgttgtccttgaggccgacgggcccgacgcgggcgggttgaacgcgctggtgaggcggtcacccgggctacggcggccggcagggggcagtggcggccgttgtctagggcccggaggtggggccgcgcgcctcgggcgctacgaacccggcgggcccacgcttggctgcggccgggtgcgggctgaggccatgggcgaccgcggcagctcccggcgccggaggacagggtcgcggccctcgagccacggcggcggcgggcctgcggcggcggaagaggaggtgcgggacgccgctgcgggccccgacgtgggagccgcgggggacgcgccagccccggcccccaacaaggacggagacgccggcgtgggcagcggccactgggagctgaggtgccatcgcctgcaggattctttattcagctctgacagtggcttcagcaactaccgtggcatcctgaactggtgtgtggtgatgctgatcttgagcaatgcccggttatttctggagaacctcatcaagtatggcatcctggtggaccccatccaggtggtttctctgttcctgaaggatccctatagctggcccgccccatgcctggttattgcggccaatgtctttgctgtggctgcattccaggttgagaagcgcctggcggtgggtgccctgacggagcaggcgggactgctgctgcacgtggccaacctggccaccattctgtgtttcccagcggctgtggtcttactggttgagtctatcactccagtgggctccctgctggcgctgatggcgcacaccatcctcttcctcaagctcttctcctaccgcgacgtcaactcatggtgccgcagggccagggccaaggctgcctctgcagggaagaaggccagcagtgctgctgccccgcacaccgtgagctacccggacaatctgacctaccgcgatctctactacttcctcttcgcccccaccttgtgctacgagctcaactttccccgctctccccgcatccggaagcgctttctgctgcgacggatccttgagatgctgttcttcacccagctccaggtggggctgatccagcagtggatggtccccaccatccagaactccatgaagcccttcaaggacatggactactcacgcatcatcgagcgcctcctgaagctggcggtccccaatcacctcatctggctcatcttcttctactggctcttccactcctgcctgaatgccgtggctgagctcatgcagtttggagaccgggagttctaccgggactggtggaactccgagtctgtcacctacttctggcagaactggaacatccctgtgcacaagtggtgcatcagacacttctacaagcccatgcttcgacggggcagcagcaagtggatggccaggacaggggtgttcctggcctcggccttcttccacgagtacctggtgagcgtccctctgcgaatgttccgcctctgggcgttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggcctggcttctcactgccacctcacacccgctgccagagcccacctctcctcctaggcctcgagtgctggggatgggcctggctgcacagcatcctcctctggtcccagggaggcctctctgcccctatggggctctgtcctgcacccctcagggatggcgacagcaggccagacacagtctgatgccagctgggagtcttgctgaccctgccccgggtccgagggtgtcaataaagtgctgtccagtga

SEQ ID NO: 285771 - DNA, 896 bp, Homo sapiens
  misc_feature (896)..(896): n is a, c, g, or t
catggcaggaggaggccggggtaatcggacgaggcgctctccccgcatccggaagcgctttctgctgcgacggatccttgagatgctgttcttcacccagctccaggtggggctgatccagcagtggatggtccccaccatccagaactccatgaagcccttcaaggacatggactactcacgcatcatcgagcgcctcctgaagctggcggtccccaatcacctcatctggctcatcttcttctactggctcttccactcctgcctgaatgccgtggctgagctcatgcagtttggagaccgggagttctaccgggactggtggaactccgagtctgtcacctacttctggcagaactggaacatccctgtgcacaagtggtgcatcagacacttctacaagcccatgcttcgacgctcaccaggtactcgtggcccgcgcgtcgccgaaagcggctctgacccagcggaagtaattctttcgactgccccggaacccaccggagcaggcagctgggggtgggggggcggcctgggataggggctgtggcagtacgcggggacccggctgcggtggctgcgggactgacgagaaactactaaagttcctggggaagcaaagtagaatttcataagaacaaaatggatggagaggagaaaacctatggtggctgtgaaggacctgatgccatgtatgtccaatgtgatatcatctgatggccatgaatttatcgtcacacagagaacatgcattaacatcaggcacgataaagccatgtcgagtggccaggtcagttgcttgagaacgaaaccaatgaggtcactttagagagatacctttcacatgtgctatcgaacgtatgcatgttttttacgtcccagggtccgtacccctn

SEQ ID NO: 285772 - DNA, 1593 bp, Homo sapiens
acttcctgctcacctagggctgggctctgggtgtgagctcctttcttccggccccgtggcaaggtgccatcgcctgcaggattctttattcagctctgacagtggcttcagcaactaccgtggcatcctgaactggtgtgtggtgatgctgatcttgagcaatgcccggttatttctggagaacctcatcaagtatggcatcctggtggaccccatccaggtggtttctctgttcctgaaggatccctatagctggcccgccccatgcctggttattgcggccaatgtctttgctgtggctgcattccaggttgagaagcgcctggcggtgggtgccctgacggagcaggcgggactgctgctgcacgtggccaacctggccaccattctgtgtttcccagcggctgtggtcttactggttgagtctatcactccagtgggctccctgctggcgctgatggcgcacaccatcctcttcctcaagctcttctcctaccgcgacgtcaactcatggtgccgcagggccagggccaaggctgcctctgcagggaagaaggccagcagtgctgctgccccgcacaccgtgagctacccggacaatctgacctaccgcgatctctactacttcctcttcgcccccaccttgtgctacgagctcaactttccccgctctccccgcatccggaagcgctttctgctgcgacggatccttgagatgctgttcttcacccagctccaggtggggctgatccagcagtggatggtccccaccatccagaactccatgaagcccttcaaggacatggactactcacgcatcatcgagcgcctcctgaagctggcggtccccaatcacctcatctggctcatcttcttctactggctcttccactcctgcctgaatgccgtggctgagctcatgcagtttggagaccgggagttctaccgggactggtggaactccgagtctgtcacctacttctggcagaactggaacatccctgtgcacaagtggtgcatcagacacttctacaagcccatgcttcgacggggcagcagcaagtggatggccaggacaggggtgttcctggcctcggccttcttccacgagtacctggtgagcgtccctctgcgaatgttccgcctctgggcgttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggcctggcttctcactgccacctcacacccgctgccagagcccacctctcctcctaggcctcgagtgctggggatgggcctggctgcacagcatcctcctctggtcccagggaggcctctctgcccctatggggctctgtcctgcacccctcagggatggcgacagcaggccagacacagtctgatgccagctgggagtcttgctgaccctgccccgggtccgagggtgtcaataaagtgctgtccagtga

SEQ ID NO: 285773 - DNA, 2418 bp, Homo sapiens
  misc_feature (2002)..(2002): n is a, c, g, or t
  misc_feature (2007)..(2007): n is a, c, g, or t
cgcctcaggtcggccgcggactacaaatggacgagagaggcggccgtccattagttagcggctccggagcaacgcagccgttgtccttgaggccgacgggcccgacgcgggcgggttgaacgcgctggtgaggcggtcacccgggctacggcggccggcagggggcagtggcggccgttgtctagggcccggaggtggggccgcgcgcctcgggcgctacgaacccggcgggcccacgcttggctgcggccgggtgcgggctgaggccatgggcgaccgcggcagctcccggcgccggaggacagggtcgcggccctcgagccacggcggcggcgggcctgcggcggcggaagaggaggtgcgggacgccgctgcgggccccgacgtgggagccgcgggggacgcgccagccccggcccccaacaaggacggagacgccggcgtgggcagcggccactgggagctgaggtgccatcgcctgcaggattctttattcagctctgacagtggcttcagcaactaccgtggcatcctgaactggtgtgtggtgatgctgatcttgagcaatgcccggttatttctggagaacctcatcaagtatggcatcctggtggaccccatccaggtggtttctctgttcctgaaggatccctatagctggcccgccccatgcctggttattgcggccaatgtctttgctgtggctgcattccaggttgagaagcgcctggcggtgggtgccctgacggagcaggcgggactgctgctgcacgtggccaacctggccaccattctgtgtttcccagcggctgtggtcttactggttgagtctatcactccagtgggctccctgctggcgctgatggcgcacaccatcctcttcctcaagctcttctcctaccgcgacgtcaactcatggtgccgcagggccagggccaaggctgcctctgcagggaagaaggccagcagtgctgctgccccgcacaccgtgagctacccggacaatctgacctaccgcgatctctactacttcctcttcgcccccaccttgtgctacgagctcaactttccccgctctccccgcatccggaagcgctttctgctgcgacggatccttgagatgctgttcttcacccagctccaggtggggctgatccagcagtggatggtccccaccatccagaactccatgaagcccttcaaggacatggactactcacgcatcatcgagcgcctcctgaagctggcggtccccaatcacctcatctggctcatcttcttctactggctcttccactcctgcctgaatgccgtggctgagctcatgcagtttggagaccgggagttctaccgggactggtggaactccgagtctgtcacctacttctggcagaactggaacatccctgtgcacaagtggtgcatcagacacttctacaagcccatgcttcgacggggcagcagcaagtggatggccaggacaggggtgttcctggcctcggccttcttccacgagtacctggtgagcgtccctctgcgaatgttccgcctctgggcgttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggcctggcttctcactgccacctcacacccgctgccagagcccacctctcctcctaggcctcgagtgctggggatgggcctggctgcacagcatcctcctctggtcccagggaggcctctctgcccctatggggctctgtcctgcacccctcagggatggcgacagcaggccagacacagtctgatgccagctgggagtcttgctgaccctgccccgggtccgagggtgtcaataaagtgctgtccagtgaaaanaaaanaaaaaaacaaaaaaaaaaaaaaaaaaaaaaaaaaaaggggggggcccgccccataaataattccccgcgggggcccccattttgccgccccccctttttttttaaaagaggggcgcccccctagagaggggcggcttataaaggaggagacgacgggcggcgattaaaacagcctgtgtgtgcgtgggggaaaaccgctggaggtgggacattttgtggagagagcgacaccacatcttggtgggcgtggctgaatttgtgcggcaacaacacatcacgggtgattttgagcggccccggagggaaattaaaaatttggaaggtgttctaggtgtgttaaccagcgctgtatatagttgtgcgagtgagaaaattatggagacgggattttgtattgggaaaatttttttg

SEQ ID NO: 285774 - DNA, 1449 bp, Homo sapiens
actcgcagggagctcactactcgcagggagctcactactcgcagggagctcactactcgcagggagctcactactcccagggagctcactcctgaaggatccctatagctggcccgccccatgcctggttattgcggccaatgtctttgctgtggctgcattccaggttgagaagcgcctggcggtgggtgccctgacggagcaggcgggactgctgctgcacgtggccaacctggccaccattctgtgtttcccagcggctgtggtcttactggttgagtctatcactccagtgggctccctgctggcgctgatggcgcacaccatcctcttcctcaagctcttctcctaccgcgacgtcaactcatggtgccgcagggccagggccaaggctgcctctgcagggaagaaggccagcagtgctgctgccccgcacaccgtgagctacccggacaatctgacctaccgcgatctctactacttcctcttcgcccccaccttgtgctacgagctcaactttccccgctctccccgcatccggaagcgctttctgctgcgacggatccttgagatgctgttcttcacccagctccaggtggggctgatccagcagtggatggtccccaccatccagaactccatgaagcccttcaaggacatggactactcacgcatcatcgagcgcctcctgaagctggcggtccccaatcacctcatctggctcatcttcttctactggctcttccactcctgcctgaatgccgtggctgagctcatgcagtttggagaccgggagttctaccgggactggtggaactccgagtctgtcacctacttctggcagaactggaacatccctgtgcacaagtggtgcatcagacacttctacaagcccatgcttcgacggggcagcagcaagtggatggccaggacaggggtgttcctggcctcggccttcttccacgagtacctggtgagcgtccctctgcgaatgttccgcctctgggcgttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggcctggcttctcactgccacctcacacccgctgccagagcccacctctcctcctaggcctcgagtgctggggatgggcctggctgcacagcatcctcctctggtcccagggaggcctctctgcccctatggggctctgtcctgcacccctcagggatggcgacagcaggccagacacagtctgatgccagctgggagtcttgctgaccctgccccgggtccgagggtgtcaataaagtgctgtccagtga

SEQ ID NO: 285775 - DNA, 1304 bp, Homo sapiens
cgctaggtacgaggctgggtgttagagaagcgcctggcggtgggtgccctgacggagcaggcgggactgctgctgcacgtggccaacctggccaccattctgtgtttcccagcggctgtggtcttactggttgagtctatcactccagtgggctccctgctggcgctgatggcgcacaccatcctcttcctcaagctcttctcctaccgcgacgtcaactcatggtgccgcagggccagggccaaggctgcctctgcagggaagaaggccagcagtgctgctgccccgcacaccgtgagctacccggacaatctgacctaccgcgatctctactacttcctcttcgcccccaccttgtgctacgagctcaactttccccgctctccccgcatccggaagcgctttctgctgcgacggatccttgagatgctgttcttcacccagctccaggtggggctgatccagcagtggatggtccccaccatccagaactccatgaagcccttcaaggacatggactactcacgcatcatcgagcgcctcctgaagctggcggtccccaatcacctcatctggctcatcttcttctactggctcttccactcctgcctgaatgccgtggctgagctcatgcagtttggagaccgggagttctaccgggactggtggaactccgagtctgtcacctacttctggcagaactggaacatccctgtgcacaagtggtgcatcagacacttctacaagcccatgcttcgacggggcagcagcaagtggatggccaggacaggggtgttcctggcctcggccttcttccacgagtacctggtgagcgtccctctgcgaatgttccgcctctgggcgttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggcctggcttctcactgccacctcacacccgctgccagagcccacctctcctcctaggcctcgagtgctggggatgggcctggctgcacagcatcctcctctggtcccagggaggcctctctgcccctatggggctctgtcctgcacccctcagggatggcgacagcaggccagacacagtctgatgccagctgggagtcttgctgaccctgccccgggtccgagggtgtcaataaagtgctgtccagtga

SEQ ID NO: 285776 - DNA, 488 bp, Homo sapiens
aggtgtgcattggcagatgaatggaaacgaatgttccgcctctgggcgttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggcctggcttctcactgccacctcacacccgctgccagagcccacctctcctcctaggcctcgagtgctggggatgggcctggctgcacagcatcctcctctggtcccagggaggcctctctgcccctatggggctctgtcctgcacccctcagggatggcgacagcaggccagacacagtctgatgccagctgggagtcttgctgaccctgccccgggtccgagggtgtcaataaagtgctgtccagtga

SEQ ID NO: 285777 - DNA, 193 bp, Homo sapiens
gaaagagagccagcgagaaagagcgagcccgacagcgagcgcagggagcgacaccatgcccggctggaagaagaatatccctatctgcttgcaggcagaggagcaggagagaggaagaagattgctgtctggtttgaactggaatttctcgctatgtcccactggaggtatgtcatagtctgctcttctcact

SEQ ID NO: 285778 - DNA, 2928 bp, Homo sapiens
agtcatctctgttctgctttaggagtaaagtttaccctgcagttccttctgtggtgaagttttctctttctctcggagaccagattctgcctttctgctggagggaagtgttttcacaggttctcctccttttatcttttgtgttttttttcaagccctgctgaatttgctagtcaactcaacaggaagtgaggccatggagggaggcagaagagccagggtggttattgaaagtaaaagaaacttcttcctgggagcctttcccacccccttccctgctgagcacgtggagttaggcaggttaggggactcggagactgcgatggtgccaggaaagggtggagcggattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcacgccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaaacttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatctta

SEQ ID NO: 285779 - DNA, 2651 bp, Homo sapiens
agtagagctggctggctgtgcccttccgtccttcattagacgtttgctcttgtcttagatgctcagatggtagtggataggcctgtgacgaaggtgctaccatcgtgagagtaagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcacgccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaaacttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatctta

SEQ ID NO: 285780 - DNA, 926 bp, Homo sapiens
  misc_feature (1)..(3): n is a, c, g, or t
nnnggtttcaccttgtgtctgagctggtctgaaggctggttgttcagactgagcttcctgcctgcctgtaccccgccaacagcttcagaagaaggtgactggtggctgcctgaggaataccagtgggcaagagaattagcatttctggagcatctgctgtctgagcagcccctgggtgcgtccactttctgggcacgtgaggttgggccttggccgcctgagcccttgagttggtcacttgaaccttgggaatattgagagaaacattagaatcattgccctttagaagagcagaactatgatgcctcctgtcagggatggaacgaggcattccatgcagatgacaacccaaagagagcaagagtggctctatttatatcagacaaaatcgactttaagtcaaaaactgtcacaagagacattaaagtatattatataatgaaaaaagcatcaatccaccatgaagatataacaattataaatatatgcactcaatatcagagcacctaaatatatgaaacaaacaatgacagaactgaagggagaaatagccagccatacaaaaatagtaggagacttcaacactgtactttaaataatggatagaacattcagacagaagattaataaggaaacaggggacttaaacaacattatagaccaaatggaccgaacagaaatacacagaacgttccaccctacagcagtagaacacacattatcctcaaatgcacatggaactttctccaaggtagatcacaagttgggtcacaaaacaagtctttgcaaatttaagagactgaaatcataccatgtatcttttctgaccatgatggaatgaaactaaaaatcaatggcagaaggaaaaatagaaagttcacaaatatgtggaaattaaacaacacactcttgaacaacaattaggc

SEQ ID NO: 285781 - DNA, 1362 bp, Homo sapiens
  misc_feature (1)..(3): n is a, c, g, or t
nnnggtttcaccttgtgtctgagctggtctgaaggctggttgttcagactgagcttcctgcctgcctgtaccccgccaacagcttcagaagaaggagcagcccctgggtgcgtccactttctgggcacgtgaggttgggccttggccgcctgagcccttgagttggtcacttgaaccttgggaatattgagagaaacattagaatcattgccctttagaagagcagaactatgatgcctcctgtcagggatggaacgaggcattccatgcagatgacaacccaaagagagcaagagtggctctatttatatcagacaaaatcgactttaagtcaaaaactgtcacaagagacattaaagtatattatataatgaaaaaagcatcaatccaccatgaagatataacaattataaatatatgcactcaatatcagagcacctaaatatatgaaacaaacaatgacagaactgaagggagaaatagccagccatacaaaaatagtaggagacttcaacactgtactttaaataatggatagaacattcagacagaagattaataaggaaacaggggacttaaacaacattatagaccaaatggaccgaacagaaatacacagaacgttccaccctacagcagtagaacacacattatcctcaaatgcacatggaactttctccaaggtagatcacaagttgggtcacaaaacaagtctttgcaaatttaagagactgaaatcataccatgtatcttttctgaccatgatggaatgaaactaaaaatcaatggcagaaggaaaaatagaaagttcacaaatatgtggaaattaaacaacacactcttgaacaacaattaggccataaaaataaaaaaagaaattaggaaatatcttgagataaatgaaaagaaaagcacaacatacccaaacttacaggataaaagcagtactaagcaaagaagtactaagaggtactttattgcaatacacatctgcagtgaaaaagaagaaagatctcaagtaaatagtctaacttcgtgcctcaaggagaggagaagaagatgaagaagaagaggaactaagcctaaaattagtgaaggaaataacaaagattagagtaggaaccaagaaaatacagaatagaaaagcaatagaaaaaaaatcaacaaattttttgaaaagaataacaaaagaattggttttttgaaaagataaacaaaatcaacaaatccctagttaggctaagtaagaaagagagaagactcaaataaacaatatcagaaataaaagaggagacattacaactgatgccacagaaataaaaacatgaggctataatgaacaattctattccaacaaactgg

SEQ ID NO: 285782 - DNA, 863 bp, Homo sapiens
ataatacaatgtgatgacaacaatattaatatatgtgcaaagtgctcaggaggcccaggtattgggacactgactttacaacgatggggcagaagtctgagaggtcctgtgtgaaggaaataggtagaaactagttcttcgaggaaacgaccccgagttggggtggtgcaatggaaagcaagtcctcttactagggagttgtttgtttacatctctagtgtttgacccacagagtcagctcctgggttgggtttttgttttccagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggtacagtagaacccaaaagagaaaagtaaaatatttcttatgcctatttttttttaaatcaaaagggagagaacaaaagctataccaaaagggccatgtttcaagaaaatggatttaaacatatttccctgtggaggtaaagaacattcttatacatttatcagtttcctgctttttttaaaaattaattttttaaataaaagtaatgtatgtataaatataaaatatcaaatcttactaaaagacataatgaaaagcagtaataagctttgttttgaattcagctaaatgcatagcgcttctgtggaatgtattaggcgatgaaattgctgtggtatcaaagttcttatagaggctgcatttttacaggttgggctgttaagtgcagcagaaattgtgggttcttaacagaaatagcattttcaagtattaaatattaaactggttagcaattct

SEQ ID NO: 285783 - DNA, 2891 bp, Homo sapiens
  misc_feature (1)..(3): n is a, c, g, or t
nnnggtttcaccttgtgtctgagctggtctgaaggctggttgttcagactgagcttcctgcctgcctgtaccccgccaacagcttcagaagaaggtgactggtggctgcctgaggaataccagtgggcaagagaattagcatttctggagcatctgctgtctgagcagcccctgggtgcgtccactttctgggcacgtgaggttgggccttggccgcctgagcccttgagttggtcacttgaaccttgggaatattgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacaggttccacttctgccgcatgagctgggctgaagcaaacagccagtgccagacacagtctgtacctttctggcggagggtcgatcatctattaataagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcacgccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaaacttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatctta

SEQ ID NO: 285784 - DNA, 2831 bp, Homo sapiens
  misc_feature (1)..(3): n is a, c, g, or t
nnnggtttcaccttgtgtctgagctggtctgaaggctggttgttcagactgagcttcctgcctgcctgtaccccgccaacagcttcagaagaaggtgactggtggctgcctgaggaataccagtgggcaagagaattagcatttctggagcatctgctgtctgagcagcccctgggtgcgtccactttctgggcacgtgaggttgggccttggccgcctgagcccttgagttggtcacttgaaccttgggaatattgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacaggttccacttctgccgcatgagctgggctgaagcaaacagccagtgccagacacagtctgtacctttctggcggagggtcgatcatctattaataagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcacgccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaaacttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatctta

SEQ ID NO: 285785 - DNA, 2696 bp, Homo sapiens
agtagagctggctggctgtgcccttccgtccttcattagacgtttgctcttgtcttagatgctcagatggtagtggataggcctgtgacgaaggtgctaccatcgtgagagtaagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcacgccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaaacttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatctta

SEQ ID NO: 285786 - DNA, 2928 bp, Homo sapiens
ggcctagattctagcacttcctttgtgaggctctaaccccctctcctatagtggatttgttaagaacttctgtttttgtggctttgttattataaaattttttgaaatgttgttctctaaaaaagttatgattttatgtttttcttcatgagattctttcactgccttccagctgcaagtagaatgacgtctaaatctttgtgatctgtcactgaagcccttgagtgagacacttaaatctggctgtggctctctctcttactagcttatttccaagccgtgatttttcacaacagaaaaatggggacagtaatagtagtttcttcagaggcttttagtgaaatgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcacgccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaaacttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatctta

SEQ ID NO: 285787 - DNA, 2700 bp, Homo sapiens
agtcatctctgttctgctttaggagtaaagtttaccctgcagttccttctgtggtgaagttttctctttctctcggagaccagattctgcctttctgctggagggaagtgttttcacagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcacgccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaaacttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatctta

SEQ ID NO: 285788 - DNA, 3064 bp, Homo sapiens
agtcatctctgttctgctttaggagtaaagtttaccctgcagttccttctgtggtgaagttttctctttctctcggagaccagattctgcctttctgctggagggaagtgttttcacaggttctcctccttttatcttttgtgttttttttcaagccctgctgaatttgctagtcaactcaacaggaagtgaggccatggagggaggcagaagagccagggtggttattgaaagtaaaagaaacttcttcctgggagcctttcccacccccttccctgctgagcacgtggagttaggcaggttaggggactcggagactgcgatggtgccaggaaagggtggagcggattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggtacagtagaacccaaaagagaaaagtaaaatatttcttatgcctatttttttttaaatcaaaagggagagaacaaaagctataccaaaagggccatgtttcaagaaaatggatttaaacatatttccctgtggaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcacgccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaaacttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatctta

SEQ ID NO: 285789 - DNA, 2655 bp, Homo sapiens
agtcatctctgttctgctttaggagtaaagtttaccctgcagttccttctgtggtgaagttttctctttctctcggagaccagattctgcctttctgctggagggaagtgttttcacagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcacgccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaaacttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatctta

SEQ ID NO: 285790 - DNA, 2444 bp, Homo sapiens
agtagagctggctggctgtgcccttccgtccttcattagacgtttgctcttgtcttagatgctcagatggtagtggataggcctgtgacgaaggtgctaccatcgtgagagtaagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcacgccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaaacttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatctta

SEQ ID NO: 285791 - DNA, 2817 bp, Homo sapiens
agtagagctggctggctgtgcccttccgtccttcattagacgtttgctcttgtcttagatgctcagatggtagtggataggcctgtgacgaaggtgctaccatcgtgagagtaagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggtagaaacaacctgacagccgggaatcggcaaaacctactctaaaattgaaactgacaaatcgctccatatcacagttgtttctaatcaaatattgtttggggtttccccttttaattcagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcacgccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaaacttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatctta

SEQ ID NO: 285792 - DNA, 2160 bp, Homo sapiens
ataatacaatgtgatgacaacaatattaatatatgtgcaaagtgctcaggaggcccaggtattgggacactgactttacaacgatggggcagaagtctgagaggtcctgtgtgaaggaaataggtagaaactagttcttcgaggaaacgaccccgagttggggtggtgcaatggaaagcaagtcctcttactagggagttgtttgtttacatctctagtgtttgacccacagagtcagctcctgggttgggtttttgttttccagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcacgccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaaacttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatctta

SEQ ID NO: 285793 - DNA, 1955 bp, Homo sapiens
agtagagctggctggctgtgcccttccgtccttcattagacgtttgctcttgtcttagatgctcagatggtagtggataggcctgtgacgaaggtgctaccatcgtgagagtaagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaataagaccccgtctcaaaaaaaattttttttttaataaaacaaaatttgtttgaaaacttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatctta

SEQ ID NO: 285794 - DNA, 970 bp, Homo sapiens
  misc_feature (950)..(950): n is a, c, g, or t
agtagagctggctggctgtgcccttccgtccttcattagacgtttgctcttgtcttagatgctcagatggtagtggataggcctgtgacgaaggtgctaccatcgtgagagtaagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcagggtttgngaatgtttttagctggtggc

SEQ ID NO: 285795 - DNA, 925 bp, Homo sapiens
  misc_feature (905)..(905): n is a, c, g, or t
agtagagctggctggctgtgcccttccgtccttcattagacgtttgctcttgtcttagatgctcagatggtagtggataggcctgtgacgaaggtgctaccatcgtgagagtaagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcagggtttgngaatgtttttagctggtggc

SEQ ID NO: 285796 - DNA, 1430 bp, Homo sapiens
  misc_feature (1)..(3): n is a, c, g, or t
nnnggtttcaccttgtgtctgagctggtctgaaggctggttgttcagactgagcttcctgcctgcctgtaccccgccaacagcttcagaagaaggtgactggtggctgcctgaggaataccagtgggcaagagaattagcatttctggagcatctgctgtctgagcagcccctgggtgcgtccactttctgggcacgtgaggttgggccttggccgcctgagcccttgagttggtcacttgaaccttgggaatattgagagaaacattagaatcattgccctttagaagagcagaactatgatgcctcctgtcagggatggaacgaggcattccatgcagatgacaacccaaagagagcaagagtggctctatttatatcagacaaaatcgactttaagtcaaaaactgtcacaagagacattaaagtatattatataatgaaaaaagcatcaatccaccatgaagatataacaattataaatatatgcactcaatatcagagcacctaaatatatgaaacaaacaatgacagaactgaagggagaaatagccagccatacaaaaatagtaggagacttcaacactgtactttaaataatggatagaacattcagacagaagattaataaggaaacaggggacttaaacaacattatagaccaaatggaccgaacagaaatacacagaacgttccaccctacagcagtagaacacacattatcctcaaatgcacatggaactttctccaaggtagatcacaagttgggtcacaaaacaagtctttgcaaatttaagagactgaaatcataccatgtatcttttctgaccatgatggaatgaaactaaaaatcaatggcagaaggaaaaatagaaagttcacaaatatgtggaaattaaacaacacactcttgaacaacaattaggccataaaaataaaaaaagaaattaggaaatatcttgagataaatgaaaagaaaagcacaacatacccaaacttacaggataaaagcagtactaagcaaagaagtactaagaggtactttattgcaatacacatctgcagtgaaaaagaagaaagatctcaagtaaatagtctaacttcgtgcctcaaggagaggagaagaagatgaagaagaagaggaactaagcctaaaattagtgaaggaaataacaaagattagagtaggaaccaagaaaatacagaatagaaaagcaatagaaaaaaaatcaacaaattttttgaaaagaataacaaaagaattggttttttgaaaagataaacaaaatcaacaaatccctagttaggctaagtaagaaagagagaagactcaaataaacaatatcagaaataaaagaggagacattacaactgatgccacagaaataaaaacatgaggctataatgaacaattctattccaacaaactgg

SEQ ID NO: 285797 - DNA, 1399 bp, Homo sapiens
agtagagctggctggctgtgcccttccgtccttcattagacgtttgctcttgtcttagatgctcagatggtagtggataggcctgtgacgaaggtgctaccatcgtgagagtaagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggtacagtagaacccaaaagagaaaagtaaaatatttcttatgcctatttttttttaaatcaaaagggagagaacaaaagctataccaaaagggccatgtttcaagaaaatggatttaaacatatttccctgtggaggtaaagaacattcttatacatttatcagtttcctgctttttttaaaaattaattttttaaataaaagtaatgtatgtataaatataaaatatcaaatcttactaaaagacataatgaaaagcagtaataagctttgttttgaattcagctaaatgcatagcgcttctgtggaatgtattaggcgatgaaattgctgtggtatcaaagttcttatagaggctgcatttttacaggttgggctgttaagtgcagcagaaattgtgggttcttaacagaaatagcattttcaagtattaaatattaaactggttagcaattct

SEQ ID NO: 285798 - DNA, 860 bp, Homo sapiens
  misc_feature (840)..(840): n is a, c, g, or t
agtagagctggctggctgtgcccttccgtccttcattagacgtttgctcttgtcttagatgctcagatggtagtggataggcctgtgacgaaggtgctaccatcgtgagagtaagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcagggtttgngaatgtttttagctggtggc

SEQ ID NO: 285799 - DNA, 804 bp, Homo sapiens
agtagagctggctggctgtgcccttccgtccttcattagacgtttgctcttgtcttagatgctcagatggtagtggataggcctgtgacgaaggtgctaccatcgtgagagtaagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacaggaagaagaggaaatcctgaatatctgaagtaggcttgagagagattat

SEQ ID NO: 285800 - DNA, 539 bp, Homo sapiens
ttatactttcacttgccttaagtttaattgcatcaaagatgaatccgcagatgcgatgtcaattcgaggcagagagtattggggggcattgaagcaatggggagccaagtaacgtggagaagagtgagagacacacaggtcaggagagaaagaaaccaactctaatactgacaccgaggtttctgatggtcaaaagagttcctgaataaaccaaaagtaagttattaagctctgagacaacccatttaccaggaaagctggggtaggtcttggtttcgcaccttattgtttcaaatgactgatattttgagagaaagaactacagaactatctctgagcacagcagaggagacagttcatcagttgctttcccccacagacagtcacaatattatgtgatgtatttcagaggcgatgatattctcaccatcctgactgaagtgaactatgaagtaagcaacaaggatgacaagaaaaacatggggaaacagatgcctcagcctactttcacactaagaaaaaaacttgtcttcccttct

SEQ ID NO: 285801 - DNA, 287 bp, Homo sapiens
  misc_feature (243)..(243): n is a, c, g, or t
ggaatcccagagaaggagaagcccctgtcaaccttttattgggagtggaacacatgaggttcagctcgtgccgggcactgtacattcactgaagcagctcaaggggctcagccccgacactgacgccacactgagcaggatgcacggcccggggctcacactgtccatggaggaggtggggtcagcccgaggtgggcggatggtggcccgagacaccgagagcttggttctgggactgtggcncagctgacccgtggcacagctgcacctaagactggccctggcta

SEQ ID NO: 285802 - DNA, 2068 bp, Homo sapiens
  misc_feature (833)..(833): n is a, c, g, or t
  misc_feature (1152)..(1152): n is a, c, g, or t
gcttaggggagaattagggagggactgaatactcaagggacagatttgtggataagtagcttggagggaggagaaaccgggagggggcagatggcgtagtgctggggaggcggggacacaggggaagagagagggggaaaggaatcccctgaatattcattcccagacttcaggcctgtcagtcgcagtctcggtcgtacctcccctagttgcaaccttagctgttggcagggtgaagagatggcttccccgtctagacagcccccgccaggggggtcaggactgcttcaagggagccgggctcgttcatatggaagcctggtgcaatcggcctgctccccagtgagggaaagacgcctggagcatcagttggagcccggagacaccctggctggactagcactcaaatatggggtgacgatggaacagattaaacgtgcaaaccgcctttatactaatgactccatcttcctgaagaaaaccctctacatccccatcctgacagagcccagagacctgttcaatggtttggactctgaggaagagaaagatggagaggaaaaagtacacccaagtaacagtgaagtttggccacactcaactgagaggaagaaacaagagacaggagcaggacgtgccaatggtgaagtcctccccacacctggccaggaaacccccacgcccatccatgacctctctgcctctgatttccttaagaagcttgattcacagatcagcctgtccaagaaggctgctgctcagaagctgaaaaaaggggaaaatggggtacctggggaggatgcaggtctccacctgagctccccttggatgcngcaacgagcagtcctaggtcctgtgccgctgacccgtacctctcggacccggacactacgggaccaggaggatgaaatcttcaaactctgatgtccccagaactgactgagagaagcaagatgttgaaagagaaacttcagggggagaggagcctgaggtgaggctcaagaacatggcttatgagcctgcctccctccactccagccatcctccccagcctccttgtctgccaaaaattccttggcctggggcagttttattggcaagattagggaatgggaactggacctttcccagttcttgggctgaatctagagntgagtcctttagactcaaaaggctctttttatatccttgttgcctttcctatcctttttacctttccctggccttagaacagggaagcagagactccccctcagcttcttcctcatctccaactatgtgacataatttatttggtgctaatattgaagtaatatttatttgctatattttatttcttcccactcttagctgaaaaatggaatttctatagccctggggtgaggagaacccgggaacagtgagccagtgactgctggttctccactttccccaccttgttagccaaacatgttattgaggatgaggcaatcggtgatatagcccaccacagagaatggatgactgttggccttttctccaatctcaaagtgacagatttgggctgattctttttttttttttttttggtaccccattcctgttgaatgggctcagtcttgacaaaccaattccctgtaactttttcacaattcttgactctgagaaaaagcagcactgtagggacctgaactctccattctaccagttcacccttctgacctgttctgctcagcctgtggtgaggggaacagatggaagaaggctttccttggggtttgaagaggaagccagttgtgggagtctctttgttacaccccctcccctccagaccctctctctctatgccttcctcctcactgcatatttatttgcgatttgtagcactgatctatggtacagttgttttgtttcttaaacagaagtaggtaagggaacctcagtaataatggaaatctgcctcagtctcctgtttggaaatgatgagaggtgagataagtaatgtttatatacctcctttcttctgtgatgattataaggtatacgaagctggacagattaaacattgagccctgtgcaaaaattagta

SEQ ID NO: 285803 - DNA, 668 bp, Homo sapiens
ggccagttgcacggtggccgcccccaaattcgaggaggaaggtgcaaagtggtgggaggctgcgggtctcccggagggtgaggcgttggggaccaggcgggagcacagccgaacccctacctttcgggcggggcggacaccagccgcgcgccctcgccgggcgccgggaccggaaaatcaccgcgaagggagggacgaggaaaggcggcgggtggcttcaggacaagctgtgagatatcggtgggcgaggatgtgatgcctgaagatgtggcatctaccttgaaacagtcaaggacctgaggatgaagccagcatctgaggaagacagacagaaaggatctggatacatcatgagcctgaaaagtatcttgcatacacaactggcagcacagaatcctgacaaacctctcatcagaaatcaaccacagactctttatgctcttaccaaaatgctggctttgagaactaattatgaatgaaaattactgatgtgattttcagtctagggaagaatatcaagttaaactttatgaagtccaagacaatgggaaaagaagaggtgttcctgtccaggccctcttccagttagaaggtgatggtttccagaagtctgcacctgtatttcaattacctataatggagtttataggactaaactatattcacta

SEQ ID NO: 285804 - DNA, 734 bp, Homo sapiens
ggccagttgcacggtggccgcccccaaattcgaggaggaaggtgcaaagtggtgggaggctgcgggtctcccggagggtgaggcgttggggaccaggcgggagcacagccgaacccctacctttcgggcggggcggacaccagccgcgcgccctcgccgggcgccgggaccggaaaatcaccgcgaagggagggacgaggaaaggcggcgggtggcttcaggacaaggactttgtgattacattgggcccatccagatcatccaggatcatcttcccatctcaagattcttcacttaatcacatctgcaaaattccttttgctgtgtaaggtgacgtattcacagtttctgggtattaggatgtagacatctttgtgggtggagggaggaattatttttctacatatgctatttattttgttctatcaaaaaactcttgagggtgccgagcacggtggctcacgtctataatcctagcactttggaaggccgaggtgggcggatcatttgaggtcagtagttcgagaccagcttgtccaacatggtgagaccccagtctctactaaaaatacaaaaattagtggggtgtggtggtgcgtgcctgtaatcccagctactcgggaggctgaggtaggagaatcacttgaatccaggaggcagaggttgcagtgagctgatatcatgctactgcactctggcctgggcaacagagtgagactccatctcaaaaaaaa

SEQ ID NO: 285805 - DNA, 725 bp, Homo sapiens
ggccagttgcacggtggccgcccccaaattcgaggaggaaggtgcaaagtggtgggaggctgcgggtctcccggagggtgaggcgttggggaccaggcgggagcacagccgaacccctacctttcgggcggggcggacaccagccgcgcgccctcgccgggcgccgggaccggaaaatcaccgcgaagggagggacgaggaaaggcggcgggtggcttcaggacaaggactttgtgattacattgggcccatccagatcatccaggatcatcttcccatctcaagattcttcacttaatcacatctgcaaaattccttttgctgtctgtgagatatcggtgggcgaggatgtgatgcctgaagatgtggcatctaccttgaaacagtcaaggacctgaggatgaagccagcatctgaggaagacagacagaaaggatctggatacatcatgagcctgaaaagtatcttgcatacacaactggcagcacagaatcctgacaaacctctcatcagaaatcaaccacagactctttatgctcttaccaaaatgctggctttgagaactaattatgaatgaaaattactgatgtgattttcaggtgagagaccctattagacaaaattttggattcatttttttctcttgagtaaaacatggggaaaaaatcttagaaaaaagaaaaagaaacggaaagacggagaggaatatatgagggtggcggaag

SEQ ID NO: 285806 - DNA, 2131 bp, Homo sapiens
cggccttcctcacccaccatgtctcggcagtcctccatcaccttccagtctggcagccgcaggggcttcagcaccacctcggccatcaccccggcagctggccgctcccgcttcagctctgtctctgtggcccgctctgcagcagggagtgggggcctgggaaggatcagcagtgctggggccagctttggaagccgcagcctctacaacctggggggtgccaagcgggtctccatcaatgggtgtggcagcagctgccgaagtggctttggtggcagggccagcaacgggtttggagtcaacagtggatttggctatgggggtggagttggaggaggcttcagtggccccagcttccccgtgtgtccccctggaggcatccaagaggtcactgtcaaccagagtctcctgactcctcttcacctgcaaatcgaccccaccatccagcgggtgcgggccgaggagcgcgagcagatcaagaccctcaacaataagttcgcctccttcatcgacaaggtgaggttcttggagcagcagaacaaggtcctggagaccaagtgggccctcctgcaggagcagggctccaggactgtgaggcagaacctagagcccctctttgattcctataccagtgagctccgacggcagctggaaagcatcaccaccgagaggggcaggcttgaagctgaactgaggaacatgcaggatgttgtggaagatttcaaagtcaggtacgaagatgaaattaacaagcgcacagctgctgagaatgaatttgtagccctgaaaaaggacgtagatgctgcctatatgaacaaggtggagctggaagccaaggtcaaatctctgcccgaggagatcaacttcagccactcagtctttgatgcagagctgtcccagttgcagacccaggtcggtgacacatccgtggtgctgtccatggacaacaaccgcaacctggacctggatagtatcatcgccgaggtcaaagcacaatacgaggacattgccaaccgcagccgggccgaggctgagtcctggtaccagaccaagtacgaggagctgcaggtcaccgcaggcagacatggggatgaccttcgaaacaccaaacaagagatctctgaaatgaaccgcatgatccagaggctgagagctgagattgacagcgtcaagaagcagtgttccagcttgcaaacggccattgctgatgcagagcagcggggagaactggctctcaaggatgcacgggccaagctggtggaccttgaggaggccctgcagaaggccaagcaggacatggctcggctcctgcgtgagtaccaggagctgatgaacatcaagctggccctggacgtggagatcgccacctaccgcaagctgctggaaggcgaggagtgcaggttgagtggagagggagtttctccagttaacatttctgtggtcacctctactctttccagtggctatggaagcggcagcagcattggaggtggaaacctgggcctcggtgggggcagcggctactccttcaccaccagtggtgggcatagcctgggtgcaggcctgggaggttctggattcagtgccaccagcaaccggggcttagggggcagtggttctagcgtcaagtttgtctccaccacatcctccagccagaagagctacacgcactaagagagccccatggctccctctaccctgccttgaggcctgtttgcagtcacacctggacaccagggtcctcctccttcctctctccttgtaaggtgcacctgtgctgctgggagcctggagtactggctatacccattcccaggcctaagccagcctctccctcctgacagtgcccagactgccagcagcacccgtctgttacacatgtgaaaccaaagcctgctctctcctaaggctctcattcagcctatcttgcgaggcccgggcagctggaaagtcctcctccagctccacctccctccctccctccagatgcagaggctggggagtctctcaatgccaggttgtcacccacctgtctcatagtgtttataagtggcctgctgggagtgagtgctccctctgttccctccctggaatgtgtctattaaatgcatgtgtcacctgaaaggtgtct

SEQ ID NO: 285807 - DNA, 556 bp, Homo sapiens
gggagctgccacctcagcctggagccccttggtcccagctcgccctgaggccaggcctggcccggggggtgcagtggggcccctgcccataccctgcaggcgcaggtgcagggggaaggcacgctgaattcccgaaaaaggcctgctgagaggacaggcttccccagctctgaccacagcctgcagcccagatgacccaggacagggatgcatgaaggagcatagtcagagcagtgcccgccgcggtattgaaggtgggagtgccacctggaggccccagggacacagatgtgagtagctgggcagagggctggtggctctgcacagagcccagtgggaaaagtgacgggggtgcagaggggccgtgggaagcccccaggccgcggtgcccgggagcagatgtgcaaagtacatgatgtggctgagccacagtcctgcctgcgggaaggcctggcaggacccgcccactcacccgtgctgagaggacagcgtccgcaggttgttttctggagtgagggtcaccaccacccccacgacgttcttcatgtccttctcc

SEQ ID NO: 285808 - DNA, 807 bp, Homo sapiens
cttacagttgcagccatgttccctctcaatgatctgaaaatgtgcttctctcccccttgagtgctggctgtaggtcatggcttggcactcctaggctgcccactgcagctctggggcaatctcagtgtttatatttctttcctaactttgaggcagaagaggaagggacattagtagtggttgtagccaagggtcttttgtttgtctcctcagagttccaccacccctggagaatacagcaactgtttactgcaatcagcaatcaggatggagaattcgtgctgtgggggccaatccaggggttccctgtcatgagcagtggggagtgtgtagaacccatgagagatgggctttggtcaattaaagcttgttgaaggtgtagataagggtgttagctccttcatcagtctgagggtagcaaggacagttccactgcagaagcagtggcagagaggctttcagttgcccctggaggctctctccagggagtggctgagttgctactggctcaacagttctggtagggggggttaggtagaggtccaggcctgcaagacttgcctagtgagaagatataggaatgggaacccaggtaacagtctggccacttttccatagggctgctgcagtatgcccagggcccgctccagtctctagtagcctcagattttccagtacctggagttatcatcagtgaagcctgtgaaacagcaaagatggcagcctaccgctccctttggaagctttgccctagggaggtatgaatgaacttgttgctggcccaaacacacctgtaggaggtggctg

SEQ ID NO: 285809 - DNA, 1063 bp, Homo sapiens
cgcccccgccacttttgatttgcataatataatctctccttttcaggagatgacatttgagcaagatcttaaagaaaatcagatgccttcacctgaccactgcttggtgatcccatggcactttgtacatctctccattagctctcatctcaccagcccatcattattgtatgtgctgccttctgaagcttgcagctggctacatcagtccaatgtgaataacaaaatgaagaatatcaggatgattcgagaccaggaatactacagatgtccaacacttccacctggaatccccaaagaggcccgcttttagcctccacactggttggtgacctgacatgagagaaatgacagaaatctcagaagactggcctcatgaataatcttcagtttcaatgtaacaaagcaagccttctagaaattacctgcctctgcagttcactctgctgcttcagatgaaaattttcagagttccaccacccctggagaatacagcaactgtttactgcaatcagcaatcaggatggagaattcgtgctgtgggggccaatccaggggttccctgtcatgagcagtggggagtgtgtagaacccatgagagatgggctttggtcaattaaagcttgttgaaggtgtagataagggtgttagctccttcatcagtctgagggtagcaaggacagttccactgcagaagcagtggcagagaggctttcagttgcccctggaggctctctccagggagtggctgagttgctactggctcaacagttctggtagggggggttaggtagaggtccaggcctgcaagacttgcctagtgagaagatataggaatgggaacccaggtaacagtctggccacttttccatagggctgctgcagtatgcccagggcccgctccagtctctagtagcctcagattttccagtacctggagttatcatcagtgaagcctgtgaaacagcaaagatggcagcctaccgctccctttggaagctttgccctagggaggtatgaatgaacttgttgctggcccaaacacacctgtaggaggtggctg

SEQ ID NO: 285810 - DNA, 353 bp, Homo sapiens
tagactccatctaaaaaaaacaaacaaataaacagagaagtgtaaaaagcagacgtggcctcaaggaagggactacatggccctacccttcaataggcagtcctgaggatcacagatcagtgtggtaaatgacatccattctctgactgtcagtcagagaaaggctatgttagccaacaggctttgtctaacgagacagggaagggggtgttatatatttaaaaggcttctgtgtaaaatggactacaaacattttaaagtgtcagagtaagtgtcatatatgtagatgccctattgcctccaatcaccagacttctaagcatagtcaaggtgaagtgagagttgcatgcata

SEQ ID NO: 285811 - DNA, 504 bp, Homo sapiens
tgctcctagcattaactacgtcgttaaacccttctgaatttatttcgtctgtgaaatggggaaaagatagccaccttgcataactggtgaagaattcgtaaactgacagcagaatctagtaagaggactggcccgtggtcggctcttaatggtgtcacagaataaagaaaaagactgggagagagatgggagagagatggtcagaggagaccaaagactgaaactgaagactaaaccatggaaattgggaacaagcacttactcgcttagagggtgaaaaaagtgaatttgcctacagggccaatttggaagcacctctccctggaagccagtcaatgaagagccattggaggattttaaataaggaaccgaaaaatggagtctgaaaatagaggcgcagagaccggtcaaccacaatgaagaacaagccattttgacctccatcctggctcatctcctctgtgttctcatagcatcatattatagaatggatcacaaaaaaat

SEQ ID NO: 285812 - DNA, 427 bp, Homo sapiens
aaatggaccccaggtggcctgcagtgccaagctgtttccctgccagcctcccagtctggccctgactctccaatgtgtcacagaataaagaaaaagactgggagagagatgggagagagatggtcagaggagaccaaagactgaaactgaagactaaaccatggaaattgggaacaagcacttactcgcttagagggtgaaaaaagtgaatttgcctacagggccaatttggaagcacctctccctggaagccagtcaatgaagagccattggaggattttaaataaggaaccgaaaaatggagtctgaaaatagaggcgcagagaccggtcaaccacaatgaagaacaagccattttgacctccatcctggctcatctcctctgtgttctcatagcatcatattatagaatggatcacaaaaaaat

SEQ ID NO: 285813 - DNA, 379 bp, Homo sapiens
atgacagcagaagctgccaggcatggtggtgagcacacagcaggccctcactaaaagtggagtccaaaccccacacctcagcaaagctggtttaggaacactccagggaatttctcaacatttttcctgtaagtcaatgaagagccattggaggattttaaataaggaaccgaaaaatggagtctgaaaatagaggcgcagagaccgtcaatgaagagccattggaggattttaaataaggaaccgaaaaatggagtctgaaaatagaggcgcagagaccggtcaaccacaatgaagaacaagccattttgacctccatcctggctcatctcctctgtgttctcatagcatcatattatagaatggatcacaaaaaaat

SEQ ID NO: 285814 - DNA, 246 bp, Homo sapiens
aaatggaccccaggtggcctgcagtgccaagctgtttccctgccagcctcccagtctggccctgactctccaattcaatgaagagccattggaggattttaaataaggaaccgaaaaatggagtctgaaaatagaggcgcagagaccggtcaaccacaatgaagaacaagccattttgacctccatcctggctcatctcctctgtgttctcatagcatcatattatagaatggatcacaaaaaaat

SEQ ID NO: 285815 - DNA, 1289 bp, Homo sapiens
ctttaaggccggcggttttcgcagccagcccggggcggggaaagcggagcgcgcgctccacgcgggaccgcctcccgggccgtaagtaccggcgtggcggcgcctcagcccggcctgggcgagccctgggtgctccgccgggcagctcacggcgccccgtatggcctggggatcctaagaggccctgtgacccccctcgcctggtctccctctcacccctggagggttgccgcagctccggggcccccgggcaggaagggcgcactggtcgtcccgggagaggggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggtgctcatgtgactatcacggatcgaaaagtagcattagaatttcttaaatcaaacgttcaagccaacttacctcctcatatccaaactaaaactgttgttaaggagctgacttggggacaaaatttggggagtttttctcctggagaatttgacctgatacttggtgctgatatcatatatttagaagaaacattcacagatcttcttcaaacactggaacatctctgtagcaatcactctgtgattcttttagcatgccgaattcgctatgaacgggataacaacttcttagcaatgctggagaggcaatttattgtgagaaaggttcactacgatcctgaaaaagatgtacatatttacgaagcacagaagagaaaccagaaggaggacttataattggctataatttataagaatgttgtcattgagtgtgtcacttaaggtcttagactgcaaatctaaccatatttaatgaaatgtcttactgtacaaaaagtctaagccaaaggttctcaggggagaaagcacatgtgcagttttaaaacaaagcagtgctttgtcccattgctgtgatttttagtcagactttactcagtctgaaatgcaattaacattaaaggattaagtgtgagatttcgatttatgctatttgtgtatcccatactcctcccttttaataaacagtttccactgatgatatgaagggccggtataa

SEQ ID NO: 285816 - DNA, 1135 bp, Homo sapiens
acttccagggtcggggagacggaactgcggcgaccatgtatttctggtttatcaaaccgctaacacccagtctaagggcaggttctgtcccattgttatcactatcgaagcagccgatggaggaggggaggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggtgctcatgtgactatcacggatcgaaaagtagcattagaatttcttaaatcaaacgttcaagccaacttacctcctcatatccaaactaaaactgttgttaaggagctgacttggggacaaaatttggggagtttttctcctggagaatttgacctgatacttggtgctgatatcatatatttagaagaaacattcacagatcttcttcaaacactggaacatctctgtagcaatcactctgtgattcttttagcatgccgaattcgctatgaacgggataacaacttcttagcaatgctggagaggcaatttattgtgagaaaggttcactacgatcctgaaaaagatgtacatatttacgaagcacagaagagaaaccagaaggaggacttataattggctataatttataagaatgttgtcattgagtgtgtcacttaaggtcttagactgcaaatctaaccatatttaatgaaatgtcttactgtacaaaaagtctaagccaaaggttctcaggggagaaagcacatgtgcagttttaaaacaaagcagtgctttgtcccattgctgtgatttttagtcagactttactcagtctgaaatgcaattaacattaaaggattaagtgtgagatttcgatttatgctatttgtgtatcccatactcctcccttttaataaacagtttccactgatgatatgaagggccggtataa

SEQ ID NO: 285817 - DNA, 1080 bp, Homo sapiens
acttccagggtcggggagacggaactgcggcgaccatgtatttctggtttatcaaaccgctaacacccagtctaagggcaggttctgtcccattgttatcactatcgaagcagccgatggaggaggggaggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggtgctcatgtgactatcacggatcgaaaagtagcattagaatttcttaaatcaaacgttcaagccaacttacctcctcatatccaaactaaaactgttgttaaggagctgacttggggaccatatatttagaagaaacattcacagatcttcttcaaacactggaacatctctgtagcaatcactctgtgattcttttagcatgccgaattcgctatgaacgggataacaacttcttagcaatgctggagaggcaatttattgtgagaaaggttcactacgatcctgaaaaagatgtacatatttacgaagcacagaagagaaaccagaaggaggacttataattggctataatttataagaatgttgtcattgagtgtgtcacttaaggtcttagactgcaaatctaaccatatttaatgaaatgtcttactgtacaaaaagtctaagccaaaggttctcaggggagaaagcacatgtgcagttttaaaacaaagcagtgctttgtcccattgctgtgatttttagtcagactttactcagtctgaaatgcaattaacattaaaggattaagtgtgagatttcgatttatgctatttgtgtatcccatactcctcccttttaataaacagtttccactgatgatatgaagggccggtataa

SEQ ID NO: 285818 - DNA, 570 bp, Homo sapiens
tttaatagaaaattatttcatagtgacacataatcactatacgacagtaagtataatcggtacattgacttttgagggatattctaaaagaaaacagatcactactcttcaaaagttacaaggccatcaaagacaaggaaacaaactttcacagactgaaggagactataattaaatgcgatatggtacccaaactggattatgaagagttcattcccactccactgactttgggcttgtccttgcctgtgctgtggctaacagatcacgagtagatgtaacgttcaccaaaatcaagcaaatgctttcaaaagcattgcccttttctcaaagacgtgctgctctatctagcccaggatcctagacccagatgggcacatgaaggagagccacagcaactgacctgcagctgccaaaatgtaacagaagtgaggaagaaattttaagacactgagattcgtggttgttactgtagcaacacaaattaacagaagagctgtctacactttcttttagaatgtttaccacttaccttcatcttgaaataaatggcaatttggatagtgatga

SEQ ID NO: 285819 - DNA, 659 bp, Homo sapiens
ttagaatttttcaaattttttaccctatccattttctaagaatctgcctatttatatccctcaactcattagtcttctgacattatttgttaaaatgtttgctactttatcttttactttcctaaatagggggtttatagttttatatggtcaaatccatttaaccttttcctttgttacttctgcctttagggaatctgcttttaaaatccccctacaatgtaaagttacataaaggcaaaggtgatagattgtattactttcacaatttttcactctccacttcctgtaggaagagttcattcccactccactgactttgggcttgtccttgcctgtgctgtggctaacagatcacgagtagatgtaacgttcaccaaaatcaagcaaatgctttcaaaagcattgcccttttctcaaagacgtgctgctctatctagcccaggatcctagacccagatgggcacatgaaggagagccacagcaactgacctgcagctgccaaaatgtaacagaagtgaggaagaaattttaagacactgagattcgtggttgttactgtagcaacacaaattaacagaagagctgtctacactttcttttagaatgtttaccacttaccttcatcttgaaataaatggcaatttggatagtgatga

SEQ ID NO: 285820 - DNA, 1309 bp, Homo sapiens
tcttcttccccaaacacatccgttgacacaaattccgagccaaatctcactcagattcggaagagccatgcaaaagaaattggacaaaggcttcctccacctgtttctttttttcttttgaacttgtaaacgaccttaaaagcatttggagttagttaagaacagataatgtatcttttggccagagcgtcacccaggattcttttgcacggcaggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggaggtggaatttaattctcctccccttgaatatgggctggacaaagagaaaaatggtagctcaacagtggagacacctggacagcactttaaccaagtgatcaaagttaatatcgccaattatgtatgtgctcccggatgtgatgttatgagaaaggcacactatacctctgtggaattcctccccaaaacctattatctcaatctatccatagaaaacactggacaaatgcaaactgagggatattctaaaagaaaacagatcactactcttcaaaagttacaaggccatcaaagacaaggaaacaaactttcacagactgaaggagactataattaaatgcgatatggtacccaaactggattatgtaagtaaaaaaactggggaaataaaatgtataattcagttaatggtattataccaatgtacttttatttttgataaatgtaccctggttatgtaatatactaagattagagaaagctggatgaagggtatccggaactctgtatttttacaactcctttgtaagtttaaaattacttaaaaatatattaaaaatgtatatttacctttgtactggtttgagtaaaaaaactgactttagaatgttaacattttagatggtgaaattagaagtaattcaatttttaggtaatgtttcttaatttacttataatgaacatgttttacttgtgtaataataaatttaaaaaacctgatagtaatgtaaatactctttggtaacctgcttttgtccgagaacatcttcccatcttaataaaaatacacctttatttactctt

SEQ ID NO: 285821 - DNA, 1092 bp, Homo sapiens
ctttaaggccggcggttttcgcagccagcccggggcggggaaagcggagcgcgcgctccacgcgggaccgcctcccgggccgtaagtaccggcgtggcggcgcctcagcccggcctgggcgagccctgggtgctccgccgggcagctcacggcgccccgtatggcctggggatcctaagaggccctgtgacccccctcgcctggtctccctctcacccctggagggttgccgcagctccggggcccccgggcaggaagggcgcactggtcgtcccgggagaggggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctggaaaacactggacaaatgcaaactgagggatattctaaaagaaaacagatcactactcttcaaaagttacaaggccatcaaagacaaggaaacaaactttcacagactgaaggagactataattaaatgcgatatggtacccaaactggattatgaagagttcattcccactccactgactttgggcttgtccttgcctgtgctgtggctaacagatcacgagtagatgtaacgttcaccaaaatcaagcaaatgctttcaaaagcattgcccttttctcaaagacgtgctgctctatctagcccaggatcctagacccagatgggcacatgaaggagagccacagcaactgacctgcagctgccaaaatgtaacagaagtgaggaagaaattttaagacactgagattcgtggttgttactgtagcaacacaaattaacagaagagctgtctacactttcttttagaatgtttaccacttaccttcatcttgaaataaatggcaatttggatagtgatga

SEQ ID NO: 285822 - DNA, 1038 bp, Homo sapiens
ctttaaggccggcggttttcgcagccagcccggggcggggaaagcggagcgcgcgctccacgcgggaccgcctcccgggccgtaagtaccggcgtggcggcgcctcagcccggcctgggcgagccctgggtgctccgccgggcagctcacggcgccccgtatggcctggggatcctaagaggccctgtgacccccctcgcctggtctccctctcacccctggagggttgccgcagctccggggcccccgggcaggaagggcgcactggtcgtcccgggagaggggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctggaaaacactggacaaatgcaaactgagggatattctaaaagaaaacagatcactactcttcactataattaaatgcgatatggtacccaaactggattatgaagagttcattcccactccactgactttgggcttgtccttgcctgtgctgtggctaacagatcacgagtagatgtaacgttcaccaaaatcaagcaaatgctttcaaaagcattgcccttttctcaaagacgtgctgctctatctagcccaggatcctagacccagatgggcacatgaaggagagccacagcaactgacctgcagctgccaaaatgtaacagaagtgaggaagaaattttaagacactgagattcgtggttgttactgtagcaacacaaattaacagaagagctgtctacactttcttttagaatgtttaccacttaccttcatcttgaaataaatggcaatttggatagtgatga

SEQ ID NO: 285823 - DNA, 686 bp, Homo sapiens
aataaataacaatagtattggattataactcccaaagtatgtgtctgtattgataaaataaataatgtggagaagaaacaaatcttgtttatagaattcagttgttaaatatattagaagggatggagatatacaaaattcccattagaatagcaaatagtaataattactgtagacaagatttactgatgaattctaaaactggtgggcaaaactttaaagagaaaagaatatatctgcatagcctccaagtacttcttctaaaatacacctaattactgtggtggttttaacatatgaccacaaatttctttcatattctcccttttaggaggtggaatttaattctcctccccttgaatatgggctggacaaagagaaaaatggtagctcaacagtggagacacctggacagcactttaaccaagtgatcaaagttaatatcgccaattatgtatgtgctcccggatgtgatgttatgagaaaggcacactatacctctgtggaattcctccccaaaacctattatctcaatctatccatagaaaacactggacaaatgcaaactgagggatattctaaaagaaaacagatcactactcttcaaaagttacaaggccatcaaagacaaggaaacaaactttcacagactgaaggagactataattaaatgcgatatggtaccc

SEQ ID NO: 285824 - DNA, 1378 bp, Homo sapiens
ctttaaggccggcggttttcgcagccagcccggggcggggaaagcggagcgcgcgctccacgcgggaccgcctcccgggccgtaagtaccggcgtggcggcgcctcagcccggcctgggcgagccctgggtgctccgccgggcagctcacggcgccccgtatggcctggggatcctaagaggccctgtgacccccctcgcctggtctccctctcacccctggagggttgccgcagctccggggcccccgggcaggaagggcgcactggtcgtcccgggagaggggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggaggtggaatttaattctcctccccttgaatatgggctggacaaagagaaaaatggtagctcaacagtggagacacctggacagcactttaaccaagtgatcaaagttaatatcgccaattatgtatgtgctcccggatgtgatgttatgagaaaggcacactatacctctgtggaattcctccccaaaacctattatctcaatctatccatagaaaacactggacaaatgcaaactgagggatattctaaaagaaaacagatcactactcttcaaaagttacaaggccatcaaagacaaggaaacaaactttcacagactgaaggagactataattaaatgcgatatggtacccaaactggattatgtaagtaaaaaaactggggaaataaaatgtataattcagttaatggtattataccaatgtacttttatttttgataaatgtaccctggttatgtaatatactaagattagagaaagctggatgaagggtatccggaactctgtatttttacaactcctttgtaagtttaaaattacttaaaaatatattaaaaatgtatatttacctttgtactggtttgagtaaaaaaactgactttagaatgttaacattttagatggtgaaattagaagtaattcaatttttaggtaatgtttcttaatttacttataatgaacatgttttacttgtgtaataataaatttaaaaaacctgatagtaatgtaaatactctttggtaacctgcttttgtccgagaacatcttcccatcttaataaaaatacacctttatttactctt

SEQ ID NO: 285825 - DNA, 1086 bp, Homo sapiens
ctttaaggccggcggttttcgcagccagcccggggcggggaaagcggagcgcgcgctccacgcgggaccgcctcccgggccgtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggtgctcatgtgactatcacggatcgaaaagtagcattagaatttcttaaatcaaacgttcaagccaacttacctcctcatatccaaactaaaactgttgttaaggagctgacttggggacaaaatttggggagtttttctcctggagaatttgacctgatacttggtgctgatatcatatatttagaagaaacattcacagatcttcttcaaacactggaacatctctgtagcaatcactctgtgattcttttagcatgccgaattcgctatgaacgggataacaacttcttagcaatgctggagaggcaatttattgtgagaaaggttcactacgatcctgaaaaagatgtacatatttacgaagcacagaagagaaaccagaaggaggacttataattggctataatttataagaatgttgtcattgagtgtgtcacttaaggtcttagactgcaaatctaaccatatttaatgaaatgtcttactgtacaaaaagtctaagccaaaggttctcaggggagaaagcacatgtgcagttttaaaacaaagcagtgctttgtcccattgctgtgatttttagtcagactttactcagtctgaaatgcaattaacattaaaggattaagtgtgagatttcgatttatgctatttgtgtatcccatactcctcccttttaataaacagtttccactgatgatatgaagggccggtataa

SEQ ID NO: 285826 - DNA, 1220 bp, Homo sapiens
tcttcttccccaaacacatccgttgacacaaattccgagccaaatctcactcagattcggaagagccatgcaaaagaaattggacaaaggcttcctccacctgtttctttttttcttttgaacttgtaaacgaccttaaaagcatttggagttagttaagaacagataatgtatcttttggccagagcgtcacccaggattcttttgcacggcaggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggtgctcatgtgactatcacggatcgaaaagtagcattagaatttcttaaatcaaacgttcaagccaacttacctcctcatatccaaactaaaactgttgttaaggagctgacttggggacaaaatttggggagtttttctcctggagaatttgacctgatacttggtgctgatatcatatatttagaagaaacattcacagatcttcttcaaacactggaacatctctgtagcaatcactctgtgattcttttagcatgccgaattcgctatgaacgggataacaacttcttagcaatgctggagaggcaatttattgtgagaaaggttcactacgatcctgaaaaagatgtacatatttacgaagcacagaagagaaaccagaaggaggacttataattggctataatttataagaatgttgtcattgagtgtgtcacttaaggtcttagactgcaaatctaaccatatttaatgaaatgtcttactgtacaaaaagtctaagccaaaggttctcaggggagaaagcacatgtgcagttttaaaacaaagcagtgctttgtcccattgctgtgatttttagtcagactttactcagtctgaaatgcaattaacattaaaggattaagtgtgagatttcgatttatgctatttgtgtatcccatactcctcccttttaataaacagtttccactgatgatatgaagggccggtataa

SEQ ID NO: 285827 - DNA, 1109 bp, Homo sapiens
tcttcttccccaaacacatccgttgacacaaattccgagccaaatctcactcagattcggaagagccatgcaaaagaaattggacaaaggcttcctccacctgtttctttttttcttttgaacttgtaaacgaccttaaaagcatttggagttagttaagaacagataatgtatcttttggccagagcgtcacccaggattcttttgcacggcaggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggttgtggccaagccagtccattttccaccttaacaggtgaaaatttaaatcccaaattaatctgatttgtggcagtaaaggtccttaagtgcttttagctcctcaaaaaaagaaggcaaggaaaagacaagaaagaaagaaaaaccacaacggaaagaacaaagaaacaggaaaaagaaaaaagaagaagaaagaaacgaagagaggcagaacgagaaagagaacgcacgaagaagagacagaagagagcagaaaagcaagtgagggcgggggcggggcgcggacacgagatcctgcgcgcaaggggggcacgaaccacagggcggacgggcggcagcgacaagaacccagagcccgtcggaacaggagcaacggcgggcgctccgcacagaggcaaaaggagcagaggggacaggacgacaaaacagcagaaagacgcggcgagcggcggcgcgagcaggtaggaacaaaagaaaacgagagggcggagagggaaccaacaacaccgacagcgagaggcgagcggagtcgagtcgagaaacaaagagaaacaacactagagaggggaggagaaacagaacaaggacgagaccaaacagaaaaggg

SEQ ID NO: 285828 - DNA, 2392 bp, Homo sapiens
tgagccgctgagaggctgagtggagttcactcacatggattgaggcccagttcctgggagaagagatgctgggcaggaaggtgtctgcatgtgggactctgtacagcccggtcctctcccacatctgggaggggccagagtcagacaactgctgggttcgtccctaagagaggtcatctgactggctgttcagcctaggctgcacacacccccactttcctctaccaggccacaccggaggcagtgctcacacaggcaagctaccaggccacaacaacgacacccacctcacctctggcacctctgagcatccacgtacttgcaagaactcttgctcacatcagctaagagattgcacctgctgacctagagattccggcctgtgctcctgtgctgctgagcagggcaaccagtagcaccatgtctgtgactggcgggaagatggcaccgtccctcacccaggagatcctcagccacctgggcctggccagcaagactgcagcgtgggggaccctgggcaccctcaggaccttcttgaacttcagcgtggacaaggatgcgcagaggctactgagggccattactggccaaggcgtggaccgcagtgccattgtggacgtgctgaccaaccggagcagagagcaaaggcagctcatctcacgaaacttccaggagcgcacccaacaggacctgatgaagtctctacaggcagcactttccggcaacctggagaggattgtgatggctctgctgcagcccacagcccagtttgacgcccaggaattgaggacagctctgaaggcctcagattctgctgtggacgtggccattgaaattcttgccactcgaaccccaccccagctgcaggagtgcctggcagtctacaaacacaatttccaggtggaggctgtggatggcatcacatctgagaccagtggcatcttgcaggacctgctgttggccctggccaaggggggccgtgacagctactctggaatcattgactataatctggcagaacaagatgtccaggcactgcagcgggcagaaggacctagcagagaggaaacatgggtcccagtcttcacccagcgaaatcctgaacacctcatccgagtgtttgatcagtaccagcggagcactgggcaagagctggaggaggctgtccagaaccgtttccatggagatgctcaggtggctctgctcggcctagcttcggtgatcaagaacacaccgctgtactttgctgacaaacttcatcaagccctccaggaaactgagcccaattaccaagtcctgattcgcatccttatctctcgatgtgagactgaccttctgagtatcagagctgagttcaggaagaaatttgggaagtccctctactcttctctccaggatgcagtgaaaggggattgccagtcagccctcctggccttgtgcagggctgaagacatgtgagacttccctgccccaccccacatgacatccgaggatctgagatttccgtgtttggctgaacctgggagaccagctgggcctccaagtaggataacccctcactgagcaccacattctctagcttcttgttgaggctggaactgtttctttaaaatcccttaattttcccatctcaaaattatatctgtacctgggtcatccagctccttcttgggtgtggggaaatgagttttctttgatagtttctgcctcactcatccctcctgtaccctggccagaacatctcactgatactcgaattcttttggcaaacttcgctgttgtttgtgttccctgattgaaggttgggtggagcaggacatggaccgggaagaggcactggagttggaggtgcctttgatgtgcacttggctattccgcaggaatcctgttttgccttagtgctacagtaatccacacccaggtctcccactccaggtctcccctcaccctcattctccaggaaacttcaggcaaaataattgagaaacaggcattagaacaaggtgagaaatagagggagcaaaggaccatctgtatgaactgggaagcaagcggagggccaagctaccctccccagcatgggaattcttgggttagtggagagcacaaccctcaaattcatgtgtccaagcagagatttggaaacccacctcccaggagagcactatttcccatagaaaacaaaaacaaaaacagaaacaaaaacaaaaagtcaggctttggttccccctgcaggctatattagaaatgacaggtagctgggcgcagtggctcacgcctgtaattccagcacttcgggaggccaaggcaggcggatcacttgaggtcaggaattcaagactagcctgaccaaagtgaccttatgcttagtcatggtgctaaagtggttgtt

SEQ ID NO: 285829 - DNA, 1793 bp, Homo sapiens
tgagccgctgagaggctgagtggagttcactcacatggattgaggcccagttcctgggagaagagatgctgggcaggaaggtgtctgcatgtgggactctgtacagcccggtcctctcccacatctgggaggggccagagtcagacaactgctgggttcgtccctaagagaggtcatctgactggctgttcagcctaggctgcacacacccccactttcctctaccaggccacaccggaggcagtgctcacacaggcaagctaccaggccacaacaacgacacccacctcacctctggcacctctgagcatccacgtacttgcaagaactcttgctcacatcagctaagagattgcacctgctgacctagagattccggcctgtgctcctgtgctgctgagcagggcaaccagtagcaccatgtctgtgactggcgggaagatggcaccgtccctcacccaggagatcctcagccacctgggcctggccagcaagactgcagcgtgggggaccctgggcaccctcaggaccttcttgaacttcagcgtggacaaggatgcgcagaggctactgagggccattactggccaaggcgtggaccgcagtgccattgtggacgtgctgaccaaccggagcagagagcaaaggcagctcatctcacgaaacttccaggagcgcacccaacaggacctgatgaagtctctacaggcagcactttccggcaacctggagaggattgtgatggctctgctgcagcccacagcccagtttgacgcccaggaattgaggacagctctgaaggcctcagattctgctgtggacgtggccattgaaattcttgccactcgaaccccaccccagctgcaggagtgcctggcagtctacaaacacaatttccaggtggaggctgtggatggcatcacatctgagaccagtggcatcttgcaggacctgctgttggccctggccaaggggggccgtgacagctactctggaatcattgactataatctggcagaacaagatgtccaggcactgcagcgggcagaaggacctagcagagaggaaacatgggtcccagtcttcacccagcgaaatcctgaacacctcatccgagtgtttgatcagtaccagcggagcactgggcaagagctggaggaggctgtccagaaccgtttccatggagatgctcaggtggctctgctcggcctagcttcggtgatcaagaacacaccgctgtactttgctgacaaacttcatcaagccctccaggaaactgagcccaattaccaagtcctgattcgcatccttatctctcgatgtgagactgaccttctgagtatcagagctgagttcaggaagaaatttgggaagtccctctactcttctctccaggatgcagtgaaaggggattgccagtcagccctcctggccttgtgcagggctgaagacatgtgagacttccctgccccaccccacatgacatccgaggatctgagatttccgtgtttggctgaacctgggagaccagctgggcctccaagtaggataacccctcactgagcaccacattctctagcttcttgttgaggctggaactgtttctttaaaatcccttaattttcccatctcaaaattatatctgtacctgggtcatccagctccttcttgggtgtggggaaatgagttttctttgatagtttctgcctcactcatccctcctgtaccctggccagaacatctcactgatactcgaattcttttggcaaaaaaaagtatttaaaaaaaaagaa

SEQ ID NO: 285830 - DNA, 2368 bp, Homo sapiens
  misc_feature (2346)..(2346): n is a, c, g, or t
tgagccgctgagaggctgagtggagttcactcacatggattgaggcccagttcctgggagaagagatgctgggcaggaaggtgtctgcatgtgggactctgtacagcccggtcctctcccacatctgggaggggccagagtcagacaactgctgggttcgtccctaagagaggtcatctgactggctgttcagcctaggctgcacacacccccactttcctctaccaggccacaccggaggcagtgctcacacaggcaagctaccaggccacaacaacgacacccacctcacctctggcacctctgagcatccacgtacttgcaagaactcttgctcacatcagctaagagattgcacctgctgacctagagattccggcctgtgctcctgtgctgctgagcagggcaaccagtagcaccatgtctgtgactggcgggaagatggcaccgtccctcacccaggagatcctcagccacctgggcctggccagcaagactgcagcgtgggggaccctgggcaccctcaggaccttcttgaacttcagcgtggacaaggatgcgcagaggctactgagggccattactggccaaggcgtggaccgcagtgccattgtggacgtgctgaccaaccggagcagagagcaaaggcagctcatctcacgaaacttccaggagcgcacccaacaggacctgatgaagtctctacaggcagcactttccggcaacctggagaggattgtgatggctctgctgcagcccacagcccagtttgacgcccaggaattgaggacagctctgaaggcctcagattctgctgtggacgtggccattgaaattcttgccactcgaaccccaccccagctgcaggagtgcctggcagtctacaaacacaatttccaggtggaggctgtggatggcatcacatctgagaccagtggcatcttgcaggacctgctgttggccctggccaaggggggccgtgacagctactctggaatcattgactataatctggcagaacaagatgtccaggcactgcagcgggcagaaggacctagcagagaggaaacatgggtcccagtcttcacccagcgaaatcctgaacacctcatccgagtgtttgatcagtaccagcggagcactgggcaagagctggaggaggctgtccagaaccgtttccatggagatgctcaggtggctctgctcggcctagcttcggtgatcaagaacacaccgctgtactttgctgacaaacttcatcaagccctccaggaaactgagcccaattaccaagtcctgattcgcatccttatctctcgatgtgagactgaccttctgagtatcagagctgagttcaggaagaaatttgggaagtccctctactcttctctccaggatgcagtgaaaggggattgccagtcagccctcctggccttgtgcagggctgaagacatgtgagacttccctgccccaccccacatgacatccgaggatctgagatttccgtgtttggctgaacctgggagaccagctgggcctccaagtaggataacccctcactgagcaccacattctctagcttcttgttgaggctggaactgtttctttaaaatcccttaattttcccatctcaaaattatatctgtacctgggtcatccagctccttcttgggtgtggggaaatgagttttctttgatagtttctgcctcactcatccctcctgtaccctggccagaacatctcactgatactcgaattcttttggcaaacttcgctgttgtttgtgttccctgattgaaggttgggtggagcaggacatggaccgggaagaggcactggagttggaggtgcctttgatgtgcacttggctattccgcaggaatcctgttttgccttagtgctacagtaatccacacccaggtctcccactccaggtctcccctcaccctcattctccaggaaacttcaggcaaaataattgagaaacaggcattagaacaaggtgagaaatagagggagcaaaggaccatctgtatgaactgggaagcaagcggagggccaagctaccctccccagcatgggaattcttgggttagtggagagcacaaccctcaaattcatgtgtccaagcagagatttggaaacccacctcccaggagagcactatttcccatagaaaacaaaaacaaaaacagaaacaaaaacaaaaagtcaggctttggttccccctgcaggctatattagaaatgacaggtagctgggcgcagtggctcacgcctgtaattccagcacttcgggaggccaaggcaggcggatcacttcgagcgcctggtcgacgatatccntacacccggggcgaccaactgg

SEQ ID NO: 285831 - DNA, 2215 bp, Homo sapiens
tgagccgctgagaggctgagtggagttcactcacatggattgaggcccagttcctgggagaagagatgctgggcaggaaggtgtctgcatgtgggactctgtacagcccggtcctctcccacatctgggaggggccagagtcagacaactgctgggttcgtccctaagagaggtcatctgactggctgttcagcctaggctgcacacacccccactttcctctaccaggccacaccggaggcagtgctcacacaggcaagctaccaggccacaacaacgacacccacctcacctctggcacctctgagcatccacgtacttgcaagaactcttgctcacatcagctaagagattgcacctgctgacctagagattccggcctgtgctcctgtgctgctgagcagggcaaccagtagcaccatgtctgtgactggcgggaagatggcaccgtccctcacccaggagatcctcagccacctgggcctggccagcaagactgcagcgtgggggaccctgggcaccctcaggaccttcttgaacttcagcgtggacaaggatgcgcagaggctactgagggccattactggccaaggcgtggaccgcagtgccattgtggacgtgctgaccaaccggagcagagagcaaaggcagctcatctcacgaaacttccaggagcgcacccaacaggacctgatgaagtctctacaggcagcactttccggcaacctggagaggattgtgatggctctgctgcagcccacagcccagtttgacgcccaggaattgaggacagctctgaaggcctcagattctgctgtggacgtggccattgaaattcttgccactcgaaccccaccccagctgcaggagtgcctggcagtctacaaacacaatttccaggtggaggctgtggatggcatcacatctgagaccagtggcatcttgcaggacctgctgttggccctggccaaggggggccgtgacagctactctggaatcattgactataatctggcagaacaagatgtccaggcactgcagcgggcagaaggacctagcagagaggaaacatgggtcccagtcttcacccagcgaaatcctgaacacctcatccgagtgtttgatcagtaccagcggagcactgggcaagagctggaggaggctgtccagaaccgtttccatggagatgctcaggtggctctgctcggcctagcttcggtgatcaagaacacaccgctgtactttgctgacaaacttcatcaagccctccaggatgcagtgaaaggggattgccagtcagccctcctggccttgtgcagggctgaagacatgtgagacttccctgccccaccccacatgacatccgaggatctgagatttccgtgtttggctgaacctgggagaccagctgggcctccaagtaggataacccctcactgagcaccacattctctagcttcttgttgaggctggaactgtttctttaaaatcccttaattttcccatctcattttctttgatagtttctgcctcactcatccctcctgtaccctggccagaacatctcactgatactcgaattcttttggcaaacttcgctgttgtttgtgttccctgattgaaggttgggtggagcaggacatggaccgggaagaggcactggagttggaggtgcctttgatgtgcacttggctattccgcaggaatcctgttttgccttagtgctacagtaatccacacccaggtctcccactccaggtctcccctcaccctcattctccaggaaacttcaggcaaaataattgagaaacaggcattagaacaaggtgagaaatagagggagcaaaggaccatctgtatgaactgggaagcaagcggagggccaagctaccctccccagcatgggaattcttgggttagtggagagcacaaccctcaaattcatgtgtccaagcagagatttggaaacccacctcccaggagagcactatttcccatagaaaacaaaaacaaaaacagaaacaaaaacaaaaagtcaggctttggttccccctgcaggctatattagaaatgacaggtagctgggcgcagtggctcacgcctgtaattccagcacttcgggaggccaaggcaggcggatcacttgaggtcaggaattcaagactagcctgaccaaagtgaccttatgcttagtcatggtgctaaagtggttgtt

SEQ ID NO: 285832 - DNA, 1820 bp, Homo sapiens
caacttagctctagtacgaggctgggtgttatttggccaccccggtgcgcgggtatggcggccagcctgtggatgggcgacctggaaccctacatggatgagaacttcatctccagagcctttgccaccatgggggagaccgtaatgagcgtcaaaattatccgaaaccgcctcactgggatcccagctggctactgctttgtagaatttgcagatttggccacagctgagaagtgtttgcataaaattaatgggaaaccccttccaggagccacacctgcgaaacgttttaaactgaactatgccacttacgggaaacaaccagataacagccctgagtattccctctttgtgggggacctgaccccggacgtggatgatggcatgctgtatgaattcttcgtcaaagtctacccctcctgtcggggaggcaaggtggttttggaccagacaggcgtgtctaagggttatggttttgtgaaattcacagatgaactggaacagaagcgagccctgacggagtgccagggagcagtgggactggggtctaagcctgtgcggctgagcgtggcaatccctaaagcgagccgtgtaaagccagtggaatatagtcagatgtacagttatagctacaaccagtattatcagcagtaccagaactactatgctcagtggggctatgaccagaacacaggcagctacagctacagttacccccagtatggctatacccagagcaccatgcagacatatgaagaagttggagatgatgcattggaagaccccatgccacagctggatgtgactgaggccaacaaggagttcatggaacagagtgaggagctgtatgacgctctgatggactgtcactggcagcccctggacacagtgtcttcagagatccctgccatgatgtagccaggccaaaggacaagccaggttgcatgatgtgagggagatgagagactcctttttaaaaattgtgaaacctttttggaaatatgatttgtaagattttaataatgactgtttttggagatcatgaatgtttctacaacactgctgcattcatttgaccatttgagtttgaagaccaagggaacaacttttaaacaaggttcaaattggtttccttcacaggaatcctttgtccaggtagttatccacataggacagtttgggattatccaaaactgggatgagcagcttgggataattcacacactaaagcctgagttcaaggtttctcagttgacaggtaggtatgtaaatcagggttctctggagtatttgtaggacctgccatatttgagtcctaacttggtgcaagtctggcagctaggtagaaaaggcactctagcaggtgtggtaggagcacgccccagaaggtagaatgtggtggggtgtgatggaacaggccagttggcctaagaattagtacttgctctaataatgggtttcatctattttcatgagttgcagcatctgcatatacaaggcctggatcactttaggatcaatattttgacacgggagaaggcagctcagaaaggattaaggaagatagctcaaagccaaagcagaccctccgtgtgaactttatactgctcacttccgtgtttcccaagtaaatggggaaactgtccaaccttgtcatgtgttgggacttactgcttgaggcaaagcattcatcctacatcataaaaaatctccaaagatctctttaagggctgggcatggtggctcactttgggagatggattgcttgagctcgggaagagaccagttcggtctctacaaaaaaatacaaacacaaatat

SEQ ID NO: 285833 - DNA, 1901 bp, Homo sapiens
agcgggtagcggtctccgcagccaggattggcgcccgcgcgggccttcgagccccgcccgcagagccccgcccgcaaagccccaccccggtgcgcgggtatggcggccagcctgtggatgggcgacctggaaccctacatggatgagaacttcatctccagagcctttgccaccatgggggagaccgtaatgagcgtcaaaattatccgaaaccgcctcactgggatcccagctggctactgctttgtagaatttgcagatttggccacagctgagaagtgtttgcataaaattaatgggaaaccccttccaggagccacacctgcgaaacgttttaaactgaactatgccacttacgggaaacaaccagataacagccctgagtattccctctttgtgggggacctgaccccggacgtggatgatggcatgctgtatgaattcttcgtcaaagtctacccctcctgtcggggaggcaaggtggttttggaccagacaggcgtgtctaagggttatggttttgtgaaattcacagatgaactggaacagaagcgagccctgacggagtgccagggagcagtgggactggggtctaagcctgtgcggctgagcgtggcaatccctaaagcgagccgtgtaaagccagtggaatatagtcagatgtacagttatagctacaaccagtattatcagcagtaccagaactactatgctcagtggggctatgaccagaacacaggcagctacagctacagttacccccagtatggctatacccagagcaccatgcagacatatgaagaagttggagatgatgcattggaagaccccatgccacagctggatgtgactgaggccaacaaggagttcatggaacagagtgaggagctgtatgacgctctgatggactgtcactggcagcccctggacacagtgtcttcagagatccctgccatgatgtagccaggccaaaggacaagccaggttgcatgatgtgagggagatgagagactcctttttaaaaattgtgaaacctttttggaaatatgatttgtaagattttaataatgactgtttttggagatcatgaatgtttctacaacactgctgcattcatttgaccatttgagtttgaagaccaagggaacaacttttaaacaaggttcaaattggtttccttcacaggaatcctttgtccaggtagttatccacataggacagtttgggattatccaaaactgggatgagcagcttgggataattcacacactaaagcctgagttcaaggtttctcagttgacaggtaggtatgtaaatcagggttctctggagtatttgtaggacctgccatatttgagtcctaacttggtgcaagtctggcagctaggtagaaaaggcactctagcaggtgtggtaggagcacgccccagaaggtagaatgtggtggggtgtgatggaacaggccagttggcctaagaattagtacttgctctaataatgggtttcatctattttcatgagttgcagcatctgcatatacaaggcctggatcactttaggatcaatattttgacacgggagaaggcagctcagaaaggattaaggaagatagctcaaagccaaagcagaccctccgtgtgaactttatactgctcacttccgtgtttcccaagtaaatggggaaactgtccaaccttgtcatgtgttgggacttactgcttgaggcaaagcattcatcctacatcataaaaaatctccaaagatctctttaagggctgggcatggtggctcactttgggagatggattgcttgagctcgggaagagaccagttcggtctctacaaaaaaatacaaacacaaatatacttttattagtctttttattcttctttattgatca

SEQ ID NO: 285834 - DNA, 2554 bp, Homo sapiens
caacttagctctagtacgaggctgggtgttatttggccaccccggtgcgcgggtatggcggccagcctgtggatgggcgacgtgagtgagggcagccgtccggggtctgaagacaaggaagcatctcggtttcgcgagagaggaaggatctgagtgggaggggacttgggatcccagaaaggggagacgtgtgacgggggttctttttggtgacacagaagcgggttccagcatctaagtgaagaggctgactggaaccctacatggatgagaacttcatctccagagcctttgccaccatgggggagaccgtaatgagcgtcaaaattatccgaaaccgcctcactgggatcccagctggctactgctttgtagaatttgcagatttggccacagctgagaagtgtttgcataaaattaatgggaaaccccttccaggagccacacctgtaaggacatttagataatgatgatgttgccattattattgtcattgcttactaccatctattgaatccctactgtatacttattttatttaatcctaaaacaaccctttacagtaggcattgttatctttgtaggcccaggaaactgaagctcagggaattgaaataacttgtccaaggcaacacaggtagtaaatggcagagccaggattcagactgaagattggttgcctcccaaatccatgcctttccattctgcattgctgcctcccataaccgaagacttgaaactctagacctcttgcctgattgggaaactagaataggctggcagcagcaaggacacatttcaagagagttgcattctgctcttcccacagttacttagcttacagctgcaccagctggcacacctgggctcatagaaccatggagctggcagtgcccttagcggtcatccgtgcaaccccctcattttatacaggagaaaaagctgaggcttagagagggggagatgttttggccaaggcgaaacgttttaaactgaactatgccacttacgggaaacaaccagataacagccctgagtattccctctttgtgggggacctgaccccggacgtggatgatggcatgctgtatgaattcttcgtcaaagtctacccctcctgtcggggaggcaaggtggttttggaccagacaggcgtgtctaagggttatggttttgtgaaattcacagatgaactggaacagaagcgagccctgacggagtgccagggagcagtgggactggggtctaagcctgtgcggctgagcgtggcaatccctaaagcgagccgtgtaaagccagtggaatatagtcagatgtacagttatagctacaaccagtattatcagcagtaccagaactactatgctcagtggggctatgaccagaacacaggcagctacagctacagttacccccagtatggctatacccagagcaccatgcagacatatgaagaagttggagatgatgcattggaagaccccatgccacagctggatgtgactgaggccaacaaggagttcatggaacagagtgaggagctgtatgacgctctgatggactgtcactggcagcccctggacacagtgtcttcagagatccctgccatgatgtagccaggccaaaggacaagccaggttgcatgatgtgagggagatgagagactcctttttaaaaattgtgaaacctttttggaaatatgatttgtaagattttaataatgactgtttttggagatcatgaatgtttctacaacactgctgcattcatttgaccatttgagtttgaagaccaagggaacaacttttaaacaaggttcaaattggtttccttcacaggaatcctttgtccaggtagttatccacataggacagtttgggattatccaaaactgggatgagcagcttgggataattcacacactaaagcctgagttcaaggtttctcagttgacaggtaggtatgtaaatcagggttctctggagtatttgtaggacctgccatatttgagtcctaacttggtgcaagtctggcagctaggtagaaaaggcactctagcaggtgtggtaggagcacgccccagaaggtagaatgtggtggggtgtgatggaacaggccagttggcctaagaattagtacttgctctaataatgggtttcatctattttcatgagttgcagcatctgcatatacaaggcctggatcactttaggatcaatattttgacacgggagaaggcagctcagaaaggattaaggaagatagctcaaagccaaagcagaccctccgtgtgaactttatactgctcacttccgtgtttcccaagtaaatggggaaactgtccaaccttgtcatgtgttgggacttactgcttgaggcaaagcattcatcctacatcataaaaaatctccaaagatctctttaagggctgggcatggtggctcactttgggagatggattgcttgagctcgggaagagaccagttcggtctctacaaaaaaatacaaacacaaatatacttttattagtctttttattcttctttattgatca

SEQ ID NO: 285835 - DNA, 2751 bp, Homo sapiens
caacttagctctagtacgaggctgggtgttatttggccaccccggtgcgcgggtatggcggccagcctgtggatgggcgacgtgagtgagggcagccgtccggggtctgaagacaaggaagcatctcggtttcgcgagagaggaaggatctgagtgggaggggacttgggatcccagaaaggggagacgtgtgacgggggttctttttggtgacacagaagcgggttccagcatctaagtgaagaggctgagtccgtgaggctaggggtcctggggccccacctgggttcgtgggagggaaaggtggtgctttggggacatagaatgggagcaatccaaggactgaggcgcgctgttctgggaccggaggagtggggtttctaggtccaaggggaggctccctaaagcggggcaagcttgaaccaaaagagctggggtttcaggccgctcagtggaggcgaacctcgcccctcgctcccccagcggcgcgtagccagccctgggctgaacgggaggggctctggaacccggagtgggaagcccggccgccggcctgagccgctgtgctcttgtttttacgcagctggaaccctacatggatgagaacttcatctccagagcctttgccaccatgggggagaccgtaatgagcgtcaaaattatccgaaaccgcctcactgggatcccagctggctactgctttgtagaatttgcagatttggccacagctgagaagtgtttgcataaaattaatgggaaaccccttccaggagccacacctgcccaggaaactgaagctcagggaattgaaataacttgtccaaggcaacacaggtagtaaatggcagagccaggattcagactgaagattggttgcctcccaaatccatgcctttccattctgcattgctgcctcccataaccgaagacttgaaactctagacctcttgcctgattgggaaactagaataggctggcagcagcaaggacacatttcaagagagttgcattctgctcttcccacagttacttagcttacagctgcaccagctggcacacctgggctcatagaaccatggagctggcagtgcccttagcggtcatccgtgcaaccccctcattttatacaggagaaaaagctgaggcttagagagggggagatgttttggccaaggcgaaacgttttaaactgaactatgccacttacgggaaacaaccagataacagccctgagtattccctctttgtgggggacctgaccccggacgtggatgatggcatgctgtatgaattcttcgtcaaagtctacccctcctgtcggggaggcaaggtggttttggaccagacaggcgtgtctaagggttatggttttgtgaaattcacagatgaactggaacagaagcgagccctgacggagtgccagggagcagtgggactggggtctaagcctgtgcggctgagcgtggcaatccctaaagcgagccgtgtaaagccagtggaatatagtcagatgtacagttatagctacaaccagtattatcagcagtaccagaactactatgctcagtggggctatgaccagaacacaggcagctacagctacagttacccccagtatggctatacccagagcaccatgcagacatatgaagaagttggagatgatgcattggaagaccccatgccacagctggatgtgactgaggccaacaaggagttcatggaacagagtgaggagctgtatgacgctctgatggactgtcactggcagcccctggacacagtgtcttcagagatccctgccatgatgtagccaggccaaaggacaagccaggttgcatgatgtgagggagatgagagactcctttttaaaaattgtgaaacctttttggaaatatgatttgtaagattttaataatgactgtttttggagatcatgaatgtttctacaacactgctgcattcatttgaccatttgagtttgaagaccaagggaacaacttttaaacaaggttcaaattggtttccttcacaggaatcctttgtccaggtagttatccacataggacagtttgggattatccaaaactgggatgagcagcttgggataattcacacactaaagcctgagttcaaggtttctcagttgacaggtaggtatgtaaatcagggttctctggagtatttgtaggacctgccatatttgagtcctaacttggtgcaagtctggcagctaggtagaaaaggcactctagcaggtgtggtaggagcacgccccagaaggtagaatgtggtggggtgtgatggaacaggccagttggcctaagaattagtacttgctctaataatgggtttcatctattttcatgagttgcagcatctgcatatacaaggcctggatcactttaggatcaatattttgacacgggagaaggcagctcagaaaggattaaggaagatagctcaaagccaaagcagaccctccgtgtgaactttatactgctcacttccgtgtttcccaagtaaatggggaaactgtccaaccttgtcatgtgttgggacttactgcttgaggcaaagcattcatcctacatcataaaaaatctccaaagatctctttaagggctgggcatggtggctcactttgggagatggattgcttgagctcgggaagagaccagttcggtctctacaaaaaaatacaaacacaaatatacttttattagtctttttattcttctttattgatca

SEQ ID NO: 285836 - DNA, 2004 bp, Homo sapiens
caacttagctctagtacgaggctgggtgttatttggccaccccggtgcgcgggtatggcggccagcctgtggatgggcgacctggaaccctacatggatgagaacttcatctccagagcctttgccaccatgggggagaccgtaatgagcgtcaaaattatccgaaaccgcctcactgggatcccagctggctactgctttgtagaatttgcagatttggccacagctgagaagtgtttgcataaaattaatgggaaaccccttccaggagccacacctttacttagcttacagctgcaccagctggcacacctgggctcatagaaccatggagctggcagtgcccttagcggtcatccgtgcaaccccctcattttatacaggagaaaaagctgaggcttagagagggggagatgttttggccaaggcgaaacgttttaaactgaactatgccacttacgggaaacaaccagataacagccctgagtattccctctttgtgggggacctgaccccggacgtggatgatggcatgctgtatgaattcttcgtcaaagtctacccctcctgtcggggaggcaaggtggttttggaccagacaggcgtgtctaagggttatggttttgtgaaattcacagatgaactggaacagaagcgagccctgacggagtgccagggagcagtgggactggggtctaagcctgtgcggctgagcgtggcaatccctaaagcgagccgtgtaaagccagtggaatatagtcagatgtacagttatagctacaaccagtattatcagcagtaccagaactactatgctcagtggggctatgaccagaacacaggcagctacagctacagttacccccagtatggctatacccagagcaccatgcagacatatgaagaagttggagatgatgcattggaagaccccatgccacagctggatgtgactgaggccaacaaggagttcatggaacagagtgaggagctgtatgacgctctgatggactgtcactggcagcccctggacacagtgtcttcagagatccctgccatgatgtagccaggccaaaggacaagccaggttgcatgatgtgagggagatgagagactcctttttaaaaattgtgaaacctttttggaaatatgatttgtaagattttaataatgactgtttttggagatcatgaatgtttctacaacactgctgcattcatttgaccatttgagtttgaagaccaagggaacaacttttaaacaaggttcaaattggtttccttcacaggaatcctttgtccaggtagttatccacataggacagtttgggattatccaaaactgggatgagcagcttgggataattcacacactaaagcctgagttcaaggtttctcagttgacaggtaggtatgtaaatcagggttctctggagtatttgtaggacctgccatatttgagtcctaacttggtgcaagtctggcagctaggtagaaaaggcactctagcaggtgtggtaggagcacgccccagaaggtagaatgtggtggggtgtgatggaacaggccagttggcctaagaattagtacttgctctaataatgggtttcatctattttcatgagttgcagcatctgcatatacaaggcctggatcactttaggatcaatattttgacacgggagaaggcagctcagaaaggattaaggaagatagctcaaagccaaagcagaccctccgtgtgaactttatactgctcacttccgtgtttcccaagtaaatggggaaactgtccaaccttgtcatgtgttgggacttactgcttgaggcaaagcattcatcctacatcataaaaaatctccaaagatctctttaagggctgggcatggtggctcactttgggagatggattgcttgagctcgggaagagaccagttcggtctctacaaaaaaatacaaacacaaatatacttttattagtctttttattcttctttattgatca

SEQ ID NO: 285837 - DNA, 2031 bp, Homo sapiens
agcgggtagcggtctccgcagccaggattggcgcccgcgcgggccttcgagccccgcccgcagagccccgcccgcaaagccccaccccggtgcgcgggtatggcggccagcctgtggatgggcgacctggaaccctacatggatgagaacttcatctccagagcctttgccaccatgggggagaccgtaatgagcgtcaaaattatccgaaaccgcctcactgggatcccagctggctactgctttgtagaatttgcagatttggccacagctgagaagtgtttgcataaaattaatgggaaaccccttccaggagccacacctgcgaaacgttttaaactgaactatgccacttacgggaaacaaccagataacagccctgagtattccctctttgtgggggacctgaccccggacgtggatgatggcatgctgtatgaattcttcgtcaaagtctacccctcctgtcggggaggcaaggtggttttggaccagacaggcgtgtctaagggttatggttttgtgaaattcacagatgaactggaacagaagcgagccctgacggagtgccagggagcagtgggactggggtctaagcctgtgcggctgagcgtggcaatccctaaagcgagccgtgtaaagccagtggaatatagtcagatgtacagttatagctacaaccagtattatcagcagtaccagaactactatgctcagtggggctatgaccagaacacaggcagctacagctacagttacccccagtatggctatacccagagcaccatgcagacatatgaagaagttggagatgatgcattggaagaggcagggtttcaccatgttgcccaggctggtcttgaactcctaggttcaagtgatctgcccatctcggccttccaaagtgctggcattataggcatgagccactgctcctggccaaaactttttttgagaccccatgccacagctggatgtgactgaggccaacaaggagttcatggaacagagtgaggagctgtatgacgctctgatggactgtcactggcagcccctggacacagtgtcttcagagatccctgccatgatgtagccaggccaaaggacaagccaggttgcatgatgtgagggagatgagagactcctttttaaaaattgtgaaacctttttggaaatatgatttgtaagattttaataatgactgtttttggagatcatgaatgtttctacaacactgctgcattcatttgaccatttgagtttgaagaccaagggaacaacttttaaacaaggttcaaattggtttccttcacaggaatcctttgtccaggtagttatccacataggacagtttgggattatccaaaactgggatgagcagcttgggataattcacacactaaagcctgagttcaaggtttctcagttgacaggtaggtatgtaaatcagggttctctggagtatttgtaggacctgccatatttgagtcctaacttggtgcaagtctggcagctaggtagaaaaggcactctagcaggtgtggtaggagcacgccccagaaggtagaatgtggtggggtgtgatggaacaggccagttggcctaagaattagtacttgctctaataatgggtttcatctattttcatgagttgcagcatctgcatatacaaggcctggatcactttaggatcaatattttgacacgggagaaggcagctcagaaaggattaaggaagatagctcaaagccaaagcagaccctccgtgtgaactttatactgctcacttccgtgtttcccaagtaaatggggaaactgtccaaccttgtcatgtgttgggacttactgcttgaggcaaagcattcatcctacatcataaaaaatctccaaagatctctttaagggctgggcatggtggctcactttgggagatggattgcttgagctcgggaagagaccagttcggtctctacaaaaaaatacaaacacaaatatacttttattagtctttttattcttctttattgatca

SEQ ID NO: 285838 - DNA, 2071 bp, Homo sapiens
caacttagctctagtacgaggctgggtgttatttggccaccccggtgcgcgggtatggcggccagcctgtggatgggcgacgtgagtgagggcagccgtccggggtctgaagacaaggaagcatctcggtttcgcgagagaggaaggatctgagtgggaggggacttgggatcccagaaaggggagacgtgtgacgggggttctttttggtgacacagaagcgggttccagcatctaagtgaagaggctgagtccgtgaggctaggggtcctggggccccacctgggttcgtgggagggaaaggtggtgctttggggacatagaatgggagcaatccaaggactgaggcgcgctgttctgggaccggaggagtggggtttctaggtccaaggggaggctccctaaagcggggcaagcttgaaccaaaagagctggggtttcaggccgctcagtggaggcgaacctcgcccctcgctcccccagcggcgcgtagccagccctgggctgaacgggaggggctctggaacccggagtgggaagcccggccgccggcctgagccgctgtgctcttgtttttacgcagctggaaccctacatggatgagaacttcatctccagagcctttgccaccatgggggagaccgtaatgagcgtcaaaattatccgaaaccgcctcactgggatcccagctggctactgctttgtagaatttgcagatttggccacagctgagaagtgtttgcataaaattaatgggaaaccccttccaggagccacacctttacttagcttacagctgcaccagctggcacacctgggctcatagaaccatggagctggcagtgcccttagcggtcatccgtgcaaccccctcattttatacaggagaaaaagctgaggcttagagagggggagatgttttggccaaggcgaaacgttttaaactgaactatgccacttacgggaaacaaccagataacagccctgagtattccctctttgtgggggacctgaccccggacgtggatgatggcatgctgtatgaattcttcgtcaaagtctacccctcctgtcggggaggcaaggtggttttggaccagacaggcgtgtctaagtaaggccttacttgttactgatgcttaactgtgttagtttcagcctttctctcctgagtggaggtgttttagaaaggccctgcagcatggcgattaagaccacaagctctggagccaaactgcctggttcaaatcccagctccaatacaggtgagggagaatgccagtattgtagaattgaagctctgtgacccttacagccccatctgtaaaatggagctgattaataatagctgcttgtagggttgatgtaaggattaaaggatataatataagtaagtcacatttgaaatgctttataggtgtttgctgttttgcttgttattgttactgagcctttcagtgtagttagaagtgttccacttcaggctgggcgtggtggctcatgcctgtaatcctaacactttgagaggcccaggtgggtggattgcgtgagcttaggagttggagaccagcccgggcaacacggtgaaatgccgtctctattaaaatacaaaaaattagccggatgtggtggtgtgcacctgtagtcccagctacttgggaggctgaggtaggataattgctttaacctggaaggcggaggttgcaatgagccaagattgtgccactgcactccagcctgggcaacagagccagactctgtctccataaaaaaaaaaaaaaagttggcccggcatggtggctcacacctgtaatcccagcactttgggaagctgaggtggatggatcacctgaggtcaggactttgaaaccagcctggctaacatggcaaaaccccatctctactaaaaaaatacaaaagttagccgggcatggtggcatgcgcctgtagtcccagctactcgggaggctgaggcagaattgcttgaatccgggaggcagaggttgcagtgagctgagatcacacaactgtgctccagcctgggtaacagagcaagattctgtctcaaata

SEQ ID NO: 285839 - DNA, 2536 bp, Homo sapiens
caacttagctctagtacgaggctgggtgttatttggccaccccggtgcgcgggtatggcggccagcctgtggatgggcgacgtgagtgagggcagccgtccggggtctgaagacaaggaagcatctcggtttcgcgagagaggaaggatctgagtgggaggggacttgggatcccagaaaggggagacgtgtgacgggggttctttttggtgacacagaagcgggttccagcatctaagtgaagaggctgagtccgtgaggctaggggtcctggggccccacctgggttcgtgggagggaaaggtggtgctttggggacatagaatgggagcaatccaaggactgaggcgcgctgttctgggaccggaggagtggggtttctaggtccaaggggaggctccctaaagcggggcaagcttgaaccaaaagagctggggtttcaggccgctcagtggaggcgaacctcgcccctcgctcccccagcggcgcgtagccagccctgggctgaacgggaggggctctggaacccggagtgggaagcccggccgccggcctgagccgctgtgctcttgtttttacgcagctggaaccctacatggatgagaacttcatctccagagcctttgccaccatgggggagaccgtaatgagcgtcaaaattatccgaaaccgcctcactgggatcccagctggctactgctttgtagaatttgcagatttggccacagctgagaagtgtttgcataaaattaatgggaaaccccttccaggagccacacctgtaaggacatttagataatgatgatgttgccattattattgtcattgcttactaccatctattgaatccctactgtatacttattttatttaatcctaaaacaaccctttacagtaggcattgttatctttgtaggcccaggaaactgaagctcagggaattgaaataacttgtccaaggcaacacaggtagtaaatggcagagccaggattcagactgaagattggttgcctcccaaatccatgcctttccattctgcattgctgcctcccataaccgaagacttgaaactctagacctcttgcctgattgggaaactagaataggctggcagcagcaaggacacatttcaagagagttgcattctgctcttcccacagttacttagcttacagctgcaccagctggcacacctgggctcatagaaccatggagctggcagtgcccttagcggtcatccgtgcaaccccctcattttatacaggagaaaaagctgaggcttagagagggggagatgttttggccaaggtaatttatttcagttttcttcaaatattgttcaactcttgaaacacctttctctgttttagtttgtttgtttttcaacttccaggcgaaacgttttaaactgaactatgccacttacgggaaacaaccagataacagccctgagtattccctctttgtgggggacctgaccccggacgtggatgatggcatgctgtatgaattcttcgtcaaagtctacccctcctgtcggggaggcaaggtggttttggaccagacaggcgtgtctaagtaaggccttacttgttactgatgcttaactgtgttagtttcagcctttctctcctgagtggaggtgttttagaaaggccctgcagcatggcgattaagaccacaagctctggagccaaactgcctggttcaaatcccagctccaatacaggtgagggagaatgccagtattgtagaattgaagctctgtgacccttacagccccatctgtaaaatggagctgattaataatagctgcttgtagggttgatgtaaggattaaaggatataatataagtaagtcacatttgaaatgctttataggtgtttgctgttttgcttgttattgttactgagcctttcagtgtagttagaagtgttccacttcaggctgggcgtggtggctcatgcctgtaatcctaacactttgagaggcccaggtgggtggattgcgtgagcttaggagttggagaccagcccgggcaacacggtgaaatgccgtctctattaaaatacaaaaaattagccggatgtggtggtgtgcacctgtagtcccagctacttgggaggctgaggtaggataattgctttaacctggaaggcggaggttgcaatgagccaagattgtgccactgcactccagcctgggcaacagagccagactctgtctccataaaaaaaaaaaaaaagttggcccggcatggtggctcacacctgtaatcccagcactttgggaagctgaggtggatggatcacctgaggtcaggactttgaaaccagcctggctaacatggcaaaaccccatctctactaaaaaaatacaaaagttagccgggcatggtggcatgcgcctgtagtcccagctactcgggaggctgaggcagaattgcttgaatccgggaggcagaggttgcagtgagctgagatcacacaactgtgctccagcctgggtaacagagcaagattctgtctcaaata

SEQ ID NO: 285840 - DNA, 1455 bp, Homo sapiens
gagagagagagagagagagagagagagagagagagagagagagagagagaggcgagccgtgtaaagccagtggaatatagtcagatgtacagttatagctacaaccagtattatcagcagtaccagaactactatgctcagtggggctatgaccagaacacaggcagctacagctacagttacccccagtatggctatacccagagcaccatgcagacatatgaagaagttggagatgatgcattggaagaggcagggtttcaccatgttgcccaggctggtcttgaactcctaggttcaagtgatctgcccatctcggccttccaaagtgctggcattataggcatgagccactgctcctggccaaaactttttttgagaccccatgccacagctggatgtgactgaggccaacaaggagttcatggaacagagtgaggagctgtatgacgctctgatggactgtcactggcagcccctggacacagtgtcttcagagatccctgccatgatgtagccaggccaaaggacaagccaggttgcatgatgtgagggagatgagagactcctttttaaaaattgtgaaacctttttggaaatatgatttgtaagattttaataatgactgtttttggagatcatgaatgtttctacaacactgctgcattcatttgaccatttgagtttgaagaccaagggaacaacttttaaacaaggttcaaattggtttccttcacaggaatcctttgtccaggtagttatccacataggacagtttgggattatccaaaactgggatgagcagcttgggataattcacacactaaagcctgagttcaaggtttctcagttgacaggtaggtatgtaaatcagggttctctggagtatttgtaggacctgccatatttgagtcctaacttggtgcaagtctggcagctaggtagaaaaggcactctagcaggtgtggtaggagcacgccccagaaggtagaatgtggtggggtgtgatggaacaggccagttggcctaagaattagtacttgctctaataatgggtttcatctattttcatgagttgcagcatctgcatatacaaggcctggatcactttaggatcaatattttgacacgggagaaggcagctcagaaaggattaaggaagatagctcaaagccaaagcagaccctccgtgtgaactttatactgctcacttccgtgtttcccaagtaaatggggaaactgtccaaccttgtcatgtgttgggacttactgcttgaggcaaagcattcatcctacatcataaaaaatctccaaagatctctttaagggctgggcatggtggctcactttgggagatggattgcttgagctcgggaagagaccagttcggtctctacaaaaaaatacaaacacaaatatacttttattagtctttttattcttctttattgatca

SEQ ID NO: 285841 - DNA, 1856 bp, Homo sapiens
caacttagctctagtacgaggctgggtgttatttggccaccccggtgcgcgggtatggcggccagcctgtggatgggcgacctggaaccctacatggatgagaacttcatctccagagcctttgccaccatgggggagaccgtaatgagcgtcaaaattatccgaaaccgcctcactgggatcccagctggctactgctttgtagaatttgcagatttggccacagctgagaagtgtttgcataaaattaatgggaaaccccttccaggagccacacctgcgaaacgttttaaactgaactatgccacttacgggaaacaaccagataacagccctgagtattccctctttgtgggggacctgaccccggacgtggatgatggcatgctgtatgaattcttcgtcaaagtctacccctcctgtcggggaggcaaggtggttttggaccagacaggcgtgtctaagggttatggttttgtgaaattcacagatgaactggaacagaagcgagccctgacggagtgccagggagcagtgggactggggtctaagcctgtgcggctgagcgtggcaatccctaaagcgagccgtgtaaagccagtggaatatagtcagatgtacagttatagctacaaccagtattatcagcagtaccagaactactatgctcagtggggctatgaccagaacacaggcagctacagctacagttacccccagtatggctatacccagagcaccatgcagacatatgaagaagttggagatgatgcattggaagaccccatgccacagctggatgtgactgaggccaacaaggagttcatggaacagagtgaggagctgtatgacgctctgatggactgtcactggcagcccctggacacagtgtcttcagagatccctgccatgatgtagccaggccaaaggacaagccaggttgcatgatgtgagggagatgagagactcctttttaaaaattgtgaaacctttttggaaatatgatttgtaagattttaataatgactgtttttggagatcatgaatgtttctacaacactgctgcattcatttgaccatttgagtttgaagaccaagggaacaacttttaaacaaggttcaaattggtttccttcacaggaatcctttgtccaggtagttatccacataggacagtttgggattatccaaaactgggatgagcagcttgggataattcacacactaaagcctgagttcaaggtttctcagttgacaggtaggtatgtaaatcagggttctctggagtatttgtaggacctgccatatttgagtcctaacttggtgcaagtctggcagctaggtagaaaaggcactctagcaggtgtggtaggagcacgccccagaaggtagaatgtggtggggtgtgatggaacaggccagttggcctaagaattagtacttgctctaataatgggtttcatctattttcatgagttgcagcatctgcatatacaaggcctggatcactttaggatcaatattttgacacgggagaaggcagctcagaaaggattaaggaagatagctcaaagccaaagcagaccctccgtgtgaactttatactgctcacttccgtgtttcccaagtaaatggggaaactgtccaaccttgtcatgtgttgggacttactgcttgaggcaaagcattcatcctacatcataaaaaatctccaaagatctctttaagggctgggcatggtggctcactttgggagatggattgcttgagctcgggaagagaccagttcggtctctacaaaaaaatacaaacacaaatatacttttattagtctttttattcttctttattgatca

SEQ ID NO: 285842 - DNA, 2886 bp, Homo sapiens
caacttagctctagtacgaggctgggtgttatttggccaccccggtgcgcgggtatggcggccagcctgtggatgggcgacgtgagtgagggcagccgtccggggtctgaagacaaggaagcatctcggtttcgcgagagaggaaggatctgagtgggaggggacttgggatcccagaaaggggagacgtgtgacgggggttctttttggtgacacagaagcgggttccagcatctaagtgaagaggctgagtccgtgaggctaggggtcctggggccccacctgggttcgtgggagggaaaggtggtgctttggggacatagaatgggagcaatccaaggactgaggcgcgctgttctgggaccggaggagtggggtttctaggtccaaggggaggctccctaaagcggggcaagcttgaaccaaaagagctggggtttcaggccgctcagtggaggcgaacctcgcccctcgctcccccagcggcgcgtagccagccctgggctgaacgggaggggctctggaacccggagtgggaagcccggccgccggcctgagccgctgtgctcttgtttttacgcagctggaaccctacatggatgagaacttcatctccagagcctttgccaccatgggggagaccgtaatgagcgtcaaaattatccgaaaccgcctcactgggatcccagctggctactgctttgtagaatttgcagatttggccacagctgagaagtgtttgcataaaattaatgggaaaccccttccaggagccacacctgtaaggacatttagataatgatgatgttgccattattattgtcattgcttactaccatctattgaatccctactgtatacttattttatttaatcctaaaacaaccctttacagtaggcattgttatctttgtaggcccaggaaactgaagctcagggaattgaaataacttgtccaaggcaacacaggtagtaaatggcagagccaggattcagactgaagattggttgcctcccaaatccatgcctttccattctgcattgctgcctcccataaccgaagacttgaaactctagacctcttgcctgattgggaaactagaataggctggcagcagcaaggacacatttcaagagagttgcattctgctcttcccacagttacttagcttacagctgcaccagctggcacacctgggctcatagaaccatggagctggcagtgcccttagcggtcatccgtgcaaccccctcattttatacaggagaaaaagctgaggcttagagagggggagatgttttggccaaggcgaaacgttttaaactgaactatgccacttacgggaaacaaccagataacagccctgagtattccctctttgtgggggacctgaccccggacgtggatgatggcatgctgtatgaattcttcgtcaaagtctacccctcctgtcggggaggcaaggtggttttggaccagacaggcgtgtctaagggttatggttttgtgaaattcacagatgaactggaacagaagcgagccctgacggagtgccagggagcagtgggactggggtctaagcctgtgcggctgagcgtggcaatccctaaagcgagccgtgtaaagccagtggaatatagtcagatgtacagttatagctacaaccagtattatcagcagtaccagaactactatgctcagtggggctatgaccagaacacaggcagctacagctacagttacccccagtatggctatacccagagcaccatgcagacatatgaagaagttggagatgatgcattggaagaccccatgccacagctggatgtgactgaggccaacaaggagttcatggaacagagtgaggagctgtatgacgctctgatggactgtcactggcagcccctggacacagtgtcttcagagatccctgccatgatgtagccaggccaaaggacaagccaggttgcatgatgtgagggagatgagagactcctttttaaaaattgtgaaacctttttggaaatatgatttgtaagattttaataatgactgtttttggagatcatgaatgtttctacaacactgctgcattcatttgaccatttgagtttgaagaccaagggaacaacttttaaacaaggttcaaattggtttccttcacaggaatcctttgtccaggtagttatccacataggacagtttgggattatccaaaactgggatgagcagcttgggataattcacacactaaagcctgagttcaaggtttctcagttgacaggtaggtatgtaaatcagggttctctggagtatttgtaggacctgccatatttgagtcctaacttggtgcaagtctggcagctaggtagaaaaggcactctagcaggtgtggtaggagcacgccccagaaggtagaatgtggtggggtgtgatggaacaggccagttggcctaagaattagtacttgctctaataatgggtttcatctattttcatgagttgcagcatctgcatatacaaggcctggatcactttaggatcaatattttgacacgggagaaggcagctcagaaaggattaaggaagatagctcaaagccaaagcagaccctccgtgtgaactttatactgctcacttccgtgtttcccaagtaaatggggaaactgtccaaccttgtcatgtgttgggacttactgcttgaggcaaagcattcatcctacatcataaaaaatctccaaagatctctttaagggctgggcatggtggctcactttgggagatggattgcttgagctcgggaagagaccagttcggtctctacaaaaaaatacaaacacaaatatacttttattagtctttttattcttctttattgatca

SEQ ID NO: 285843 - DNA, 2249 bp, Homo sapiens
caacttagctctagtacgaggctgggtgttatttggccaccccggtgcgcgggtatggcggccagcctgtggatgggcgacctggaaccctacatggatgagaacttcatctccagagcctttgccaccatgggggagaccgtaatgagcgtcaaaattatccgaaaccgcctcactgggatcccagctggctactgctttgtagaatttgcagatttggccacagctgagaagtgtttgcataaaattaatgggaaaccccttccaggagccacacctgcccaggaaactgaagctcagggaattgaaataacttgtccaaggcaacacaggtagtaaatggcagagccaggattcagactgaagattggttgcctcccaaatccatgcctttccattctgcattgctgcctcccataaccgaagacttgaaactctagacctcttgcctgattgggaaactagaataggctggcagcagcaaggacacatttcaagagagttgcattctgctcttcccacagttacttagcttacagctgcaccagctggcacacctgggctcatagaaccatggagctggcagtgcccttagcggtcatccgtgcaaccccctcattttatacaggagaaaaagctgaggcttagagagggggagatgttttggccaaggcgaaacgttttaaactgaactatgccacttacgggaaacaaccagataacagccctgagtattccctctttgtgggggacctgaccccggacgtggatgatggcatgctgtatgaattcttcgtcaaagtctacccctcctgtcggggaggcaaggtggttttggaccagacaggcgtgtctaagggttatggttttgtgaaattcacagatgaactggaacagaagcgagccctgacggagtgccagggagcagtgggactggggtctaagcctgtgcggctgagcgtggcaatccctaaagcgagccgtgtaaagccagtggaatatagtcagatgtacagttatagctacaaccagtattatcagcagtaccagaactactatgctcagtggggctatgaccagaacacaggcagctacagctacagttacccccagtatggctatacccagagcaccatgcagacatatgaagaagttggagatgatgcattggaagaccccatgccacagctggatgtgactgaggccaacaaggagttcatggaacagagtgaggagctgtatgacgctctgatggactgtcactggcagcccctggacacagtgtcttcagagatccctgccatgatgtagccaggccaaaggacaagccaggttgcatgatgtgagggagatgagagactcctttttaaaaattgtgaaacctttttggaaatatgatttgtaagattttaataatgactgtttttggagatcatgaatgtttctacaacactgctgcattcatttgaccatttgagtttgaagaccaagggaacaacttttaaacaaggttcaaattggtttccttcacaggaatcctttgtccaggtagttatccacataggacagtttgggattatccaaaactgggatgagcagcttgggataattcacacactaaagcctgagttcaaggtttctcagttgacaggtaggtatgtaaatcagggttctctggagtatttgtaggacctgccatatttgagtcctaacttggtgcaagtctggcagctaggtagaaaaggcactctagcaggtgtggtaggagcacgccccagaaggtagaatgtggtggggtgtgatggaacaggccagttggcctaagaattagtacttgctctaataatgggtttcatctattttcatgagttgcagcatctgcatatacaaggcctggatcactttaggatcaatattttgacacgggagaaggcagctcagaaaggattaaggaagatagctcaaagccaaagcagaccctccgtgtgaactttatactgctcacttccgtgtttcccaagtaaatggggaaactgtccaaccttgtcatgtgttgggacttactgcttgaggcaaagcattcatcctacatcataaaaaatctccaaagatctctttaagggctgggcatggtggctcactttgggagatggattgcttgagctcgggaagagaccagttcggtctctacaaaaaaatacaaacacaaatatacttttattagtctttttattcttctttattgatca

SEQ ID NO: 285844 - DNA, 1692 bp, Homo sapiens
cggggaagctcctatttgggaatgttccctaggggtgaaggtgtcgaggaggatggtgaactgaatgtgggaattcctgcagatattagaattgtttgtacttggatcttgacactatgtggacacctgttgatgggactctcctttcttcctctagtttaatggactctctctttctcttctcagcctcttttcctttctacattcctgcccaccttcttatccttacttctttttcatgtgtccattcttagactttaatcacatttgtgatctaaattgtatatttttttcatgcaggggttatggttttgtgaaattcacagatgaactggaacagaagcgagccctgacggagtgccagggagcagtgggactggggtctaagcctgtgcggctgagcgtggcaatccctaaagcgagccgtgtaaagccagtggaatatagtcagatgtacagttatagctacaaccagtattatcagcagtaccagaactactatgctcagtggggctatgaccagaacacaggcagctacagctacagttacccccagtatggctatacccagagcaccatgcagacatatgaagaagttggagatgatgcattggaagaccccatgccacagctggatgtgactgaggccaacaaggagttcatggaacagagtgaggagctgtatgacgctctgatggactgtcactggcagcccctggacacagtgtcttcagagatccctgccatgatgtagccaggccaaaggacaagccaggttgcatgatgtgagggagatgagagactcctttttaaaaattgtgaaacctttttggaaatatgatttgtaagattttaataatgactgtttttggagatcatgaatgtttctacaacactgctgcattcatttgaccatttgagtttgaagaccaagggaacaacttttaaacaaggttcaaattggtttccttcacaggaatcctttgtccaggtagttatccacataggacagtttgggattatccaaaactgggatgagcagcttgggataattcacacactaaagcctgagttcaaggtttctcagttgacaggtaggtatgtaaatcagggttctctggagtatttgtaggacctgccatatttgagtcctaacttggtgcaagtctggcagctaggtagaaaaggcactctagcaggtgtggtaggagcacgccccagaaggtagaatgtggtggggtgtgatggaacaggccagttggcctaagaattagtacttgctctaataatgggtttcatctattttcatgagttgcagcatctgcatatacaaggcctggatcactttaggatcaatattttgacacgggagaaggcagctcagaaaggattaaggaagatagctcaaagccaaagcagaccctccgtgtgaactttatactgctcacttccgtgtttcccaagtaaatggggaaactgtccaaccttgtcatgtgttgggacttactgcttgaggcaaagcattcatcctacatcataaaaaatctccaaagatctctttaagggctgggcatggtggctcactttgggagatggattgcttgagctcgggaagagaccagttcggtctctacaaaaaaatacaaacacaaatatacttttattagtctttttattcttctttattgatca

SEQ ID NO: 285845 - DNA, 1034 bp, Homo sapiens
agcgggtagcggtctccgcagccaggattggcgcccgcgcgggccttcgagccccgcccgcagagccccgcccgcaaagccccaccccggtgcgcgggtatggcggccagcctgtggatgggcgacctggaaccctacatggatgagaacttcatctccagagcctttgccaccatgggggagaccgtaatgagcgtcaaaattatccgaaaccgcctcactgggatcccagctggctactgctttgtagaatttgcagatttggccacagctgagaagtgtttgcataaaattaatgggaaaccccttccaggagccacacctgcgaaacgttttaaactgaactatgccacttacgggaaacaaccagataacagccctgagtattccctctttgtgggggacctgaccccggacgtggatgatggcatgctgtatgaattcttcgtcaaagtctacccctcctgtcggggaggcaaggtggttttggaccagacaggcgtgtctaagggttatggttttgtgaaattcacagatgaactggaacagaagcgagccctgacggagtgccagggagcagtgggactggggtctaagcctgtgcggctgagcgtggcaatccctaaagcgagccgtgtaaagccagtggaatatagtcagatgtacagttatagctacaaccagtattatcagcagtaccagaactactatgctcagtggggctatgaccagaacacaggcagctacagctacagttacccccagtatggctatacccagagcaccatgcagacatatgaagaagttggagatgatgcattggaagaggcagggtttcaccatgttgcccaggctggtcttgaactcctaggttcaagtgatctgcccatctcggccttccaaagtgctggcattataggcatgagccactgctcctggccaaaactttttttgagaccccatgacacagctggccctgactcaggactccaagtagtacatgtttcatagtgtgaagctgcggccagcgaaga

SEQ ID NO: 285846 - DNA, 494 bp, Homo sapiens
tgtctgcccctggatcagacccagacagggaggggctgctgatgctggtagagacagagctgaggccacagtcctaccctctcctccaggccctacccagccccgccctgttggctcatgcccacaactacttaacttcttgagctgcttgaggttgctggagcggatggcagccaatagctggtcacgggagttcttctcctgggcagggaggactttgtctcccatcttcctctgggtagctgatgtgtcgctggttgtggaagcggagctcggtcagcgtgttgttctggaggagggcccggaagatggccaggatgcctttgcctgtgatgtggttggagtccaggttgaggctggtgatggtcttgttggccttgagcatgatggcaatggcaaaggccacgtggtcatcggctcgcgtgttggccaaggcgaacagcttaaccacagtgttgaactccagagcctcagtaaaccggaccaagatctca

SEQ ID NO: 285847 - DNA, 981 bp, Homo sapiens
gaccctgatcagccacataacatacactaaataatacattcaacaattctctaggacacagctgggaagtctaccatctgcaagcccggaagagaggcttcaccagaaacggaatcagccagcactttgatcttggactttccagcctccataactgcaagaaaaatgcatttctattgtttaagccacccagtctatggtatttccttatggcagcccaagctgactaagacacatgatattccatcaaaaacagatgttatttcatcaggggttgtcacagtcacaataattggatgcgaagacatcaaagaatcatcctcttgaacagatgacaggccgagaagacatcaacttctgtgaattctgcttctgcgacttctgtgtgacttttggatatgtgccaaacttttcaagccctatttctatatctgtgcaatgagaatgatgacatcactccacagatttggtctaagaattaagagaggttgcatatcaatttgccaaatattgatgttcaggtttttctaatattaacttgttattggaatttggatacttcataattaatgaaagaaaatattggcagtttatcctttagttctaatcacctctcgtttccctcctaggtcttgtcagcaatacagactggttgacaggcctagcagtactgtcagatttccttggttcaaagctcagtctttttactttctagatatataagtttaagcaagtttcctcacccattaaatagaagtaattatggcctgtactttttggaactgtgcacaggactcagtgataaaattcatggttagtacttggcatagtacctggcacagaatgagaacctaacccattagctgctatagttattttgactcttaagcagtaagattctgaaatctaactctgctaaatcactactaactttaaaaatttcattggctctacttaattaaaaatatttccaaaacagga

SEQ ID NO: 285848 - DNA, 859 bp, Homo sapiens
tttaccgttattcccaacccaaagagaaacctttaggtatcactcattctgggagaagacaaccgtcatatcatgtcatgaagatactcatgcagtcctatggagaatttcattggatattccatcaaaaacagatgttatttcatcaggggttgtcacagtcacaataattggatgcgaagacatcaaagaatcatcctcttgaacagatgacaggccgagaagacatcaacttctgtgaattctgcttctgcgacttctgtgtgacttttggatatgtgccaaacttttcaagccctatttctatatctgtgcaatgagaatgatgacatcactccacagatttggtctaagaattaagagaggttgcatatcaatttgccaaatattgatgttcaggtttttctaatattaacttgttattggaatttggatacttcataattaatgaaagaaaatattggcagtttatcctttagttctaatcacctctcgtttccctcctaggtcttgtcagcaatacagactggttgacaggcctagcagtactgtcagatttccttggttcaaagctcagtctttttactttctagatatataagtttaagcaagtttcctcacccattaaatagaagtaattatggcctgtactttttggaactgtgcacaggactcagtgataaaattcatggttagtacttggcatagtacctggcacagaatgagaacctaacccattagctgctatagttattttgactcttaagcagtaagattctgaaatctaactctgctaaatcactactaactttaaaaatttcattggctctacttaattaaaaatatttccaaaacagga

SEQ ID NO: 285849 - DNA, 793 bp, Homo sapiens
aagcggaaaatcatacttgattctagactccccaatcagtatgtttctagatattccatcaaaaacagatgttatttcatcaggggttgtcacagtcacaataattggatgcgaagacatcaaagaatcatcctcttgaacagatgacaggccgagaagacatcaacttctgtgaattctgcttctgcgacttctgtgtgacttttggatatgtgccaaacttttcaagccctatttctatatctgtgcaatgagaatgatgacatcactccacagatttggtctaagaattaagagaggttgcatatcaatttgccaaatattgatgttcaggtttttctaatattaacttgttattggaatttggatacttcataattaatgaaagaaaatattggcagtttatcctttagttctaatcacctctcgtttccctcctaggtcttgtcagcaatacagactggttgacaggcctagcagtactgtcagatttccttggttcaaagctcagtctttttactttctagatatataagtttaagcaagtttcctcacccattaaatagaagtaattatggcctgtactttttggaactgtgcacaggactcagtgataaaattcatggttagtacttggcatagtacctggcacagaatgagaacctaacccattagctgctatagttattttgactcttaagcagtaagattctgaaatctaactctgctaaatcactactaactttaaaaatttcattggctctacttaattaaaaatatttccaaaacagga

SEQ ID NO: 285850 - DNA, 793 bp, Homo sapiens
  misc_feature (33)..(33): n is a, c, g, or t
  misc_feature (37)..(38): n is a, c, g, or t
aggggggggggggggtgagggggggaggggggngggnnggggggggtcggatattccatcaaaaacagatgttatttcatcaggggttgtcacagtcacaataattggatgcgaagacatcaaagaatcatcctcttgaacagatgacaggccgagaagacatcaacttctgtgaattctgcttctgcgacttctgtgtgacttttggatatgtgccaaacttttcaagccctatttctatatctgtgcaatgagaatgatgacatcactccacagatttggtctaagaattaagagaggttgcatatcaatttgccaaatattgatgttcaggtttttctaatattaacttgttattggaatttggatacttcataattaatgaaagaaaatattggcagtttatcctttagttctaatcacctctcgtttccctcctaggtcttgtcagcaatacagactggttgacaggcctagcagtactgtcagatttccttggttcaaagctcagtctttttactttctagatatataagtttaagcaagtttcctcacccattaaatagaagtaattatggcctgtactttttggaactgtgcacaggactcagtgataaaattcatggttagtacttggcatagtacctggcacagaatgagaacctaacccattagctgctatagttattttgactcttaagcagtaagattctgaaatctaactctgctaaatcactactaactttaaaaatttcattggctctacttaattaaaaatatttccaaaacagga

SEQ ID NO: 285851 - DNA, 422 bp, Homo sapiens
ttttcttttttttctgggtgagatgaaagctatttgagggttctgagtcaaggagtgactttcattttaatggcaggctccccctggcttctgggcagagaatagcatgtatgggtgtattcctctgttttcacactgctgtaaagaactgctcaagactgggtaatttacgaagaaaagaggtttaattgactcacagttcagcttggctggggaggcctcaggaaacttacaatcatggcagaaggcaaaggggaaaaaaggcaccttcttcacaagcaaaggagggaagagccccttataaaaccatcagatctcatgagaactcactcactatcacaaaaacagcctggggaaaccacccccatgattcagttacctccacctggtctctcctttgacacatggggattatgaagatt

SEQ ID NO: 285852 - DNA, 364 bp, Homo sapiens
gctggatgttcctggctcctggggcatgggactgtgtcattcccttcaattgacaactgtgaaaagaaggccattcgaacccattctggcgttgctgggctcttcaccgtgaagtcctcagctatgtctctttctcttcgcactgcggccacagcgtcagcaatggcaaagaacacagatgaccccaggaacatcccagactccccgaggccctgtaagaaggcacattggtgtaagaaacttccatactacactacaagtttctagagggtaggggccaggtctcgttcaccattgtgtccccaacccctgcacagtgttttgtacacaaaatcttctcaataaatgtttgttggctgactta

SEQ ID NO: 285853 - DNA, 939 bp, Homo sapiens
ggttgtttttttaggtttccgtgtgtttctattgagctgctcagtgcccggcttagaagaccaggaaaaggagtcacaggtcgtatgctggaggcttgagccgcggcaccgtggcgcggctcgcctcgctgcggttggtggtggcggtggacattgcagcgcggctggaggggtaggaagaagaagatagttttgggatagatagagggtccttagacaaggtgcaagacaaacagaagagggcatgtggggtcaaactcgctagctgcctgcctgatttttctgcacacaggtgagatattcctgcacatcctctggtgaccccagaatgagggggactcgctggtgaattgcctcgggcttcacgtccagtacaggctgggtccccgtggtcgccaagcctcctgcctgctcaatgatgtaggccacgggattgcattcatacaggagccggagctgtggaggaacagaggcaggacaaattcaccaagagcctagcaacatgaagagagatgccaggaagaagagagaagccaggaaacaagccaaccgcacaatccccacatcagagcaggagaagatgggggcctgctggcagagctggggcttggctgtggtcactctgaacctgctctttggtgttttcatgagtggtgggaagaatagggaccatatggagcccacacaggaagcctagcagtacacagcaagcaggaagacaattctaaggaagcagcccatagtcttctttcttttcctgtgcatcttccactgtcagtgaggctcctcatttatggtgaacccaactgtgtgtatctcccaagttctcacccgcagattaatgttttcaggaagataggccatcaacagtgagaggaagaagttacattgtcgtatgagggatgcattttaaccattaatttgtggtacaggctgggc

SEQ ID NO: 285854 - DNA, 694 bp, Homo sapiens
ggcgccgccgccgctgccgccgctgctcgcctgggccctcctcctggccacccccgcccccgggccgggcagtgacgcgccgcggtggtgccagcccctctccccgggcagccgcggcggcagcagcagcagcagcagctggagctgtggggctgtcaccgccgcccgccccgctcactcgcggatcccgaccgcccatctccgcctcgcttccagcccaggatgagacttctgtgagcagcgaggattttgatatgagcgactccacatggatgtcagctgacccgcacctggcctccagcctgagccccagccaggacgagaggatgcggagcccgcagaacctccacagtcaagaggacgggccccaccgcttgagccacctgtcccaaggcctgaacatcatctgcagcttggacacctctctacgggccaggaaccccagggtctctgcagagagaaatgatttcagttttaggggaagatctaggtgtgtgacgtctaattcattagccaaggacggctactgagccttggaaaaggctagtgcagacaggtgtgcaatacacgctgcgtctcagcggctccgtaggaaagaagaaggtgaaatatctcagctctgataacacggtatcaattatttgttgaaatggtactattttggatatattgggttaaataaagtagattatta

SEQ ID NO: 285855 - DNA, 1045 bp, Homo sapiens
ggcgccgccgccgctgccgccgctgctcgcctgggccctcctcctggccacccccgcccccgggccgggcagtgacgcgccgcggtggtgccagcccctctccccgggcagccgcggcggcagcagcagcagcagcagctggagctgtggggctgtcaccgccgcccgccccgctcactcgcggatcccgaccgcccatctccgcctcgcttccagcccaggatgagacttctgtgagcagcgaggattttgatatgagcgactccacatggatgtcagctgacccgcacctggcctccagcctgagccccagccaggacgagaggatgcggagcccgcagaacctccacagtcaagaggacgatgactcctcctctgagagtggcagcggcaatggctcctccaccctgaacccatccacgtcgagcagcacgcagggcgaccctgccttccccgagatgaatggcaacggcgccgtggcccccatggacttcaccacggccgccgaggatcagcccatcaacctgtgtgacaagctcccgccggccacggcacttggcacagcctcctacccctcggatggctgcggtgccgacgggctgcggagccgcgtcaaatacggggtgaagaccacccccgaggtcctggtgttggcctctgctgaggaaacagctgacaccctcctaagcgctcagcagccccgggaaccagtcccccccctacagctctgggagctacgattccatcaagaccgaggtcagcggctgccctgaggacctgacagtgggccgggccccgacggcagatgatgacgacgatgaccacgatgaccatgaggacaatgacaagatgaacgactctgaaggcatggaccctgagcgtcttaaggccttcaacatgtttgtgcgtctctttgtggacgagaacctggaccgcatggtgcccatctccaagcagcccaaggagaagatccaggccatcatcgagtcctgcagccggcagttccctgagttccaggagcgggcccgcaagcgcatccgcacgt

SEQ ID NO: 285856 - DNA, 753 bp, Homo sapiens
ggcgccgccgccgctgccgccgctgctcgcctgggccctcctcctggccacccccgcccccgggccgggcagtgacgcgccgcggtggtgccagcccctctccccgggcagccgcggcggcagcagcagcagcagcagctggagctgtggggctgtcaccgccgcccgccccgctcactcgcggatcccgaccgcccatctccgcctcgcttccagcccaggatgagacttctgtgagcagcgaggattttgatatgagcgactccacatggatgtcagctgacccgcacctggcctccagcctgagccccagccaggacgagaggatgcggagcccgcagaacctccacagtcaagaggacgggccccaccgcttgagccacctgtcccaaggcctgaacatcatctgcagcttggacacctctctacgggccaggaaccccagggtctctgcagagagaaatgatttcagttttaggggaagatctaggtgtgtgacgtctaattcattagccaaggacggctactgagccttggaaaaggctagtgcagacaggtgtgcaatacacgctgcgtctcagcggctccgtaggaaagaagaaggtgaaatatctcagctctgataacacggtatcaattatttgttgaaatggtactattttggatatattgggttaaataaagtagattattacacacttgaaacaaacacgcagccaaaaaaagaggggggcccgcctataaagtttcccc

SEQ ID NO: 285857 - DNA, 544 bp, Homo sapiens
ttacaacagcctttaaaatacttgcctaagctgagctcctgaagaaacttggacctgtctccttgaccacgcctttacacccgcacctgacatctatggctctgaggcccagaaagagctgaggaggtcatagagatcatcaatgctctgcttgctttgatgtaccattaagaagacgatctttcctctaacagccccatacaactgagcagcgccaccacgtcataccgaaggaaggccctgtgagtctatgaagcggcaaaatgagtaaactgattggctgaagacagaactaatcatcctactggtatctaactccagggcctacgttaatagcatatatttccatctgtgtttaatatgcctcagaggctgagtagaggcagatcttgcttggagaggcaccatctgcctacagggattagatccgagccacattacccatatatgctcagaatggtctgtcaggaacacccttgttaatagtttagctgatactgtttctctaaggtggaagtaaaaattactaaatgaaagagcaaat

SEQ ID NO: 285858 - DNA, 940 bp, Homo sapiens
ttacaacagcctttaaaatacttgcctaagctgagctcctgaagaaacttggacctgtctccttgaccacgcctttagtacgtctgccggcccgagagtcctcttttacagtaatgttgaccatattcctaactaaagcaagacctgaccagctgccaaatagtcctccccctccctccagtggaagaaatggctactgctattcaacactgagaatgccagaacagctctgtggggctccactgaaaacctgcagcagggaggctgatgatgggagctgcttagagagcttccgaatctacttcaggtaaatatggacccgtatgtatctcctgcagcacccgcacctgacatctatggctctgaggcccagaaagagctgaggaggtcatagagatcatcaatgctctgcttgctttgatgtaccattaagaagacgatctttcctctaacagccccatacaactgagcagcgccaccacgtcataccggtacccttttctttaccccttaaagaatacccaggaaagaaagataactaaaggaagtaaaggaccagatcttttaccaccttcctgcgtgggtgatccatcctcttcctctataacatcatttccctaggacagaaggaaggccctgtgagtctatgaagcggcaaaatgagtaaactgattggctgaagacagaactaatcatcctactggtatctaactccagggcctacgttaatagcatatatttccatctgtgtttaatatgcctcagaggctgagtagaggcagatcttgcttggagaggcaccatctgcctacagggattagatccgagccacattacccatatatgctcagaatggtctgtcaggaacacccttgttaatagtttagctgatactgtttctctaaggtggaagtaaaaattactaaatgaaagagcaaat

SEQ ID NO: 285859 - DNA, 2403 bp, Homo sapiens
gatttagattgtcactgccaccctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaattttgtgcaccgagggcggcctgagcctctggatcttcacttgggcatgttcctgcccaccttgcttcaccaggcaactgcggagcagcaggagcgcttcttcatgcccgcctggaacttggagatcattggcacttatgcccagacagagatgggtcatggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcacgaggaagtaaaccagtggcacccatgtgacataggcagcagctgggcctcgggagaccagcatgcctaggctgctccactcccaaaccagagtgtcccagaggcatgacaggagcctatggtaccttcagaggaaaacctcctgttctgatgcccagagctgctgggataggcagagtacttcttggagggaatggcaccccctgcgagagacgaaagcaagagtctagggcctgagtctctcctggccaagatctctccctatatagcatgggcccg

SEQ ID NO: 285860 - DNA, 2403 bp, Homo sapiens
gatttagattgtcactgccaccctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaaactacatttggtcaattttgtggaacctgtgggcctcaattactccatgtttattcctaccttgctgaatcagggcaccactgctcagaaagagaaatggctgctttcatccaaaggactccagataattggcacctacgcccagacggaaatgggccacggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcacgaggaagtaaaccagtggcacccatgtgacataggcagcagctgggcctcgggagaccagcatgcctaggctgctccactcccaaaccagagtgtcccagaggcatgacaggagcctatggtaccttcagaggaaaacctcctgttctgatgcccagagctgctgggataggcagagtacttcttggagggaatggcaccccctgcgagagacgaaagcaagagtctagggcctgagtctctcctggccaagatctctccctatatagcatgggcccg

SEQ ID NO: 285861 - DNA, 397 bp, Homo sapiens
gatttagattgtcactgccaccctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaagtaggtatgccttagaacagagcaagtgttgttaagcctaaactttacagctgcggtctatggtggc

SEQ ID NO: 285862 - DNA, 4146 bp, Homo sapiens
gatttagattgtcactgccaccctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaattttgtgcaccgagggcggcctgagcctctggatcttcacttgggcatgttcctgcccaccttgcttcaccaggcaactgcggagcagcaggagcgcttcttcatgcccgcctggaacttggagatcattggcacttatgcccagacagagatgggtcatggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcctttcagttgaaatctaatttatacaatcattctatacttaaaggttaaatacatcttaattaattttttcttaaagtcaatgtaagtcactttgttttgtttttttttaatctacgccatatgcctcatgaaaccagctgttctagaatcagtcctgagaatatggcttaattccatggaaacataactcctatcttgggacctgacataatatctatctatcctggggaactggtaatatgagacttataggttacagcagaaatgctacatgttgacaaaagccttaatcgttccactgggagaactaattgataattgtgttaagattgaagattaaccctgtgttaatctcacttgagtctatcctgacagtagttcagattctggaaaatgataaactgacctgctagatgtagaattgtttcaaaattagtgttgaaataccttgttcacagatgaatatctgggcaggatctgagggtgtttggaatgacaccccccaatccagttgcatagatgggatgtctttgcaggtttgaggagatcatcgacctgcagagccccctttgacccagtacctcacgttttatttaaaatctaaatctggggccaggcgtggtggctcacgcctgtaatccaagcactttgggaggccgaagcgggtggatcacctgaggtcaggagtttgagaccatcctggccaacatggtgaaaccccgtctctactgaaaaaaatacaaaaattagctgggcatggtggtagcacgcgcctgtagtcccagctactcgggaggctgaggcaggataatcgcttgaacttggcgggtagaggttgcagtgagccaagatggtgccactacactgcagcctgggtggctgagcgagactccgtctcaaaaaaaaaatctaaatctgacatttgatgctatttttattaatattggaatgttctgtcttgaactttattcaatataatcaagaataaagatagagtaaacgtcactgat

SEQ ID NO: 285863 - DNA, 4146 bp, Homo sapiens
gatttagattgtcactgccaccctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaaactacatttggtcaattttgtggaacctgtgggcctcaattactccatgtttattcctaccttgctgaatcagggcaccactgctcagaaagagaaatggctgctttcatccaaaggactccagataattggcacctacgcccagacggaaatgggccacggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcctttcagttgaaatctaatttatacaatcattctatacttaaaggttaaatacatcttaattaattttttcttaaagtcaatgtaagtcactttgttttgtttttttttaatctacgccatatgcctcatgaaaccagctgttctagaatcagtcctgagaatatggcttaattccatggaaacataactcctatcttgggacctgacataatatctatctatcctggggaactggtaatatgagacttataggttacagcagaaatgctacatgttgacaaaagccttaatcgttccactgggagaactaattgataattgtgttaagattgaagattaaccctgtgttaatctcacttgagtctatcctgacagtagttcagattctggaaaatgataaactgacctgctagatgtagaattgtttcaaaattagtgttgaaataccttgttcacagatgaatatctgggcaggatctgagggtgtttggaatgacaccccccaatccagttgcatagatgggatgtctttgcaggtttgaggagatcatcgacctgcagagccccctttgacccagtacctcacgttttatttaaaatctaaatctggggccaggcgtggtggctcacgcctgtaatccaagcactttgggaggccgaagcgggtggatcacctgaggtcaggagtttgagaccatcctggccaacatggtgaaaccccgtctctactgaaaaaaatacaaaaattagctgggcatggtggtagcacgcgcctgtagtcccagctactcgggaggctgaggcaggataatcgcttgaacttggcgggtagaggttgcagtgagccaagatggtgccactacactgcagcctgggtggctgagcgagactccgtctcaaaaaaaaaatctaaatctgacatttgatgctatttttattaatattggaatgttctgtcttgaactttattcaatataatcaagaataaagatagagtaaacgtcactgat

SEQ ID NO: 285864 - DNA, 3215 bp, Homo sapiens
gatttagattgtcactgccaccctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaattttgtgcaccgagggcggcctgagcctctggatcttcacttgggcatgttcctgcccaccttgcttcaccaggcaactgcggagcagcaggagcgcttcttcatgcccgcctggaacttggagatcattggcacttatgcccagacagagatgggtcatggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcctttcagttgaaatctaatttatacaatcattctatacttaaaggttaaatacatcttaattaattttttcttaaagtca

SEQ ID NO: 285865 - DNA, 4266 bp, Homo sapiens
gatttagattgtcactgccaccctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaaactacatttggtcaattttgtggaacctgtgggcctcaattactccatgtttattcctaccttgctgaatcagggcaccactgctcagaaagagaaatggctgctttcatccaaaggactccagataattggcacctacgcccagacggaaatgggccacggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagagaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtagggaacctctcagctgtggcactgttgtagctttggagtcagagtgtactctgggcaatcagatttccacatattctgcatcttggataagcattaaaagttgggatactaatttggataaaaaaatgcactaggcaaactccagcgagacagaaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcctttcagttgaaatctaatttatacaatcattctatacttaaaggttaaatacatcttaattaattttttcttaaagtcaatgtaagtcactttgttttgtttttttttaatctacgccatatgcctcatgaaaccagctgttctagaatcagtcctgagaatatggcttaattccatggaaacataactcctatcttgggacctgacataatatctatctatcctggggaactggtaatatgagacttataggttacagcagaaatgctacatgttgacaaaagccttaatcgttccactgggagaactaattgataattgtgttaagattgaagattaaccctgtgttaatctcacttgagtctatcctgacagtagttcagattctggaaaatgataaactgacctgctagatgtagaattgtttcaaaattagtgttgaaataccttgttcacagatgaatatctgggcaggatctgagggtgtttggaatgacaccccccaatccagttgcatagatgggatgtctttgcaggtttgaggagatcatcgacctgcagagccccctttgacccagtacctcacgttttatttaaaatctaaatctggggccaggcgtggtggctcacgcctgtaatccaagcactttgggaggccgaagcgggtggatcacctgaggtcaggagtttgagaccatcctggccaacatggtgaaaccccgtctctactgaaaaaaatacaaaaattagctgggcatggtggtagcacgcgcctgtagtcccagctactcgggaggctgaggcaggataatcgcttgaacttggcgggtagaggttgcagtgagccaagatggtgccactacactgcagcctgggtggctgagcgagactccgtctcaaaaaaaaaatctaaatctgacatttgatgctatttttattaatattggaatgttctgtcttgaactttattcaatataatcaagaataaagatagagtaaacgtcactgat

SEQ ID NO: 285866 - DNA, 4704 bp, Homo sapiens
ttagttcatgctctgctcattgcacaggttaggataaactggtagtaacattgcttcctaatcatgtgttgagaagtcgtgaagatcagttagatgagatgtattttgtactttaaactttttagatacgagctttgtcaaagtacaaaattgatccctataaaatctatgacacagcacagccaaggccaactactgtggattctgttttgtaagaagagagttgaggactaaatttcaatgtgatgtagagttaatccgtagtaatgttcattgaccattggggataaatttttacatgcccacattacttattgtaaaccctgaagacctttagcgatgtatgattctgccctggaatatgtatttactcttttggatatttgcttatattatctagggaaacatagttgaaattatttcttccttggagctcttgttaacagcgctataaataagtgttctatggagttatttttgctctttgaaacaaacaggtaaaacctaaataaagcaaaaaaaaaaaaccacacacattctaaaaaattcaaccaatcaaaccagcaaataacaccaacaacctccccttccaaaaattagagaagtttttatgctaaaacttaggtagaatttgcttagtggattaaatgtaaatacgaaatgaactgtgggaactgtggccttgaaataattagaagaagagagatcatcaggttctgctgctggctttttaggtagtaaaatggtaaatcttatatttaatttcataagaagggggtttacattttcctgaccttctccttgaaggccaaagctgtttggcaagaaggggttgtaggatgcagtttctaaaggaaggctgagatccttttctcttctctcctgtagactacatttggtcaattttgtggaacctgtgggcctcaattactccatgtttattcctaccttgctgaatcagggcaccactgctcagaaagagaaatggctgctttcatccaaaggactccagataattggcacctacgcccagacggaaatgggccacggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcctttcagttgaaatctaatttatacaatcattctatacttaaaggttaaatacatcttaattaattttttcttaaagtcaatgtaagtcactttgttttgtttttttttaatctacgccatatgcctcatgaaaccagctgttctagaatcagtcctgagaatatggcttaattccatggaaacataactcctatcttgggacctgacataatatctatctatcctggggaactggtaatatgagacttataggttacagcagaaatgctacatgttgacaaaagccttaatcgttccactgggagaactaattgataattgtgttaagattgaagattaaccctgtgttaatctcacttgagtctatcctgacagtagttcagattctggaaaatgataaactgacctgctagatgtagaattgtttcaaaattagtgttgaaataccttgttcacagatgaatatctgggcaggatctgagggtgtttggaatgacaccccccaatccagttgcatagatgggatgtctttgcaggtttgaggagatcatcgacctgcagagccccctttgacccagtacctcacgttttatttaaaatctaaatctggggccaggcgtggtggctcacgcctgtaatccaagcactttgggaggccgaagcgggtggatcacctgaggtcaggagtttgagaccatcctggccaacatggtgaaaccccgtctctactgaaaaaaatacaaaaattagctgggcatggtggtagcacgcgcctgtagtcccagctactcgggaggctgaggcaggataatcgcttgaacttggcgggtagaggttgcagtgagccaagatggtgccactacactgcagcctgggtggctgagcgagactccgtctcaaaaaaaaaatctaaatctgacatttgatgctatttttattaatattggaatgttctgtcttgaactttattcaatataatcaagaataaagatagagtaaacgtcactgat

SEQ ID NO: 285867 - DNA, 4184 bp, Homo sapiens
gatttagattgtcactgccaccctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaattttgtgcaccgagggcggcctgagcctctggatcttcacttgggcatgttcctgcccaccttgcttcaccaggcaactgcggagcagcaggagcgcttcttcatgcccgcctggaacttggagatcattggcacttatgcccagacagagatgggtcatggaactcaccttcgaggcttggaaaccacagccacgtatgaccctgaaacccaggagttcattctcaacagtcctactgtgacctccattaaatggtggcctggtgggcgtaagtgaatttttcagcatttattggatgttttgaagttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcctttcagttgaaatctaatttatacaatcattctatacttaaaggttaaatacatcttaattaattttttcttaaagtcaatgtaagtcactttgttttgtttttttttaatctacgccatatgcctcatgaaaccagctgttctagaatcagtcctgagaatatggcttaattccatggaaacataactcctatcttgggacctgacataatatctatctatcctggggaactggtaatatgagacttataggttacagcagaaatgctacatgttgacaaaagccttaatcgttccactgggagaactaattgataattgtgttaagattgaagattaaccctgtgttaatctcacttgagtctatcctgacagtagttcagattctggaaaatgataaactgacctgctagatgtagaattgtttcaaaattagtgttgaaataccttgttcacagatgaatatctgggcaggatctgagggtgtttggaatgacaccccccaatccagttgcatagatgggatgtctttgcaggtttgaggagatcatcgacctgcagagccccctttgacccagtacctcacgttttatttaaaatctaaatctggggccaggcgtggtggctcacgcctgtaatccaagcactttgggaggccgaagcgggtggatcacctgaggtcaggagtttgagaccatcctggccaacatggtgaaaccccgtctctactgaaaaaaatacaaaaattagctgggcatggtggtagcacgcgcctgtagtcccagctactcgggaggctgaggcaggataatcgcttgaacttggcgggtagaggttgcagtgagccaagatggtgccactacactgcagcctgggtggctgagcgagactccgtctcaaaaaaaaaatctaaatctgacatttgatgctatttttattaatattggaatgttctgtcttgaactttattcaatataatcaagaataaagatagagtaaacgtcactgat

SEQ ID NO: 285868 - DNA, 3759 bp, Homo sapiens
ggctaaggaggagacgggtatcggcgaggctcaacagaaatggctgctttcatccaaaggactccagataattggcacctacgcccagacggaaatgggccacggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcctttcagttgaaatctaatttatacaatcattctatacttaaaggttaaatacatcttaattaattttttcttaaagtcaatgtaagtcactttgttttgtttttttttaatctacgccatatgcctcatgaaaccagctgttctagaatcagtcctgagaatatggcttaattccatggaaacataactcctatcttgggacctgacataatatctatctatcctggggaactggtaatatgagacttataggttacagcagaaatgctacatgttgacaaaagccttaatcgttccactgggagaactaattgataattgtgttaagattgaagattaaccctgtgttaatctcacttgagtctatcctgacagtagttcagattctggaaaatgataaactgacctgctagatgtagaattgtttcaaaattagtgttgaaataccttgttcacagatgaatatctgggcaggatctgagggtgtttggaatgacaccccccaatccagttgcatagatgggatgtctttgcaggtttgaggagatcatcgacctgcagagccccctttgacccagtacctcacgttttatttaaaatctaaatctggggccaggcgtggtggctcacgcctgtaatccaagcactttgggaggccgaagcgggtggatcacctgaggtcaggagtttgagaccatcctggccaacatggtgaaaccccgtctctactgaaaaaaatacaaaaattagctgggcatggtggtagcacgcgcctgtagtcccagctactcgggaggctgaggcaggataatcgcttgaacttggcgggtagaggttgcagtgagccaagatggtgccactacactgcagcctgggtggctgagcgagactccgtctcaaaaaaaaaatctaaatctgacatttgatgctatttttattaatattggaatgttctgtcttgaactttattcaatataatcaagaataaagatagagtaaacgtcactgat

SEQ ID NO: 285869 - DNA, 3119 bp, Homo sapiens
tagctcggtaccccggaaactgctgcggatgcactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcctttcagttgaaatctaatttatacaatcattctatacttaaaggttaaatacatcttaattaattttttcttaaagtcaatgtaagtcactttgttttgtttttttttaatctacgccatatgcctcatgaaaccagctgttctagaatcagtcctgagaatatggcttaattccatggaaacataactcctatcttgggacctgacataatatctatctatcctggggaactggtaatatgagacttataggttacagcagaaatgctacatgttgacaaaagccttaatcgttccactgggagaactaattgataattgtgttaagattgaagattaaccctgtgttaatctcacttgagtctatcctgacagtagttcagattctggaaaatgataaactgacctgctagatgtagaattgtttcaaaattagtgttgaaataccttgttcacagatgaatatctgggcaggatctgagggtgtttggaatgacaccccccaatccagttgcatagatgggatgtctttgcaggtttgaggagatcatcgacctgcagagccccctttgacccagtacctcacgttttatttaaaatctaaatctggggccaggcgtggtggctcacgcctgtaatccaagcactttgggaggccgaagcgggtggatcacctgaggtcaggagtttgagaccatcctggccaacatggtgaaaccccgtctctactgaaaaaaatacaaaaattagctgggcatggtggtagcacgcgcctgtagtcccagctactcgggaggctgaggcaggataatcgcttgaacttggcgggtagaggttgcagtgagccaagatggtgccactacactgcagcctgggtggctgagcgagactccgtctcaaaaaaaaaatctaaatctgacatttgatgctatttttattaatattggaatgttctgtcttgaactttattcaatataatcaagaataaagatagagtaaacgtcactgat

SEQ ID NO: 285870 - DNA, 3161 bp, Homo sapiens
gatttagattgtcactgccaccctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaattttgtgcaccgagggcggcctgagcctctggatcttcacttgggcatgttcctgcccaccttgcttcaccaggcaactgcggagcagcaggagcgcttcttcatgcccgcctggaacttggagatcattggcacttatgcccagacagagatgggtcatggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcctttcagttgaaatctaatttatacaatcattctatacttaaaggttaaatacatcttaattaattttttcttaaagtca

SEQ ID NO: 285871 - DNA, 2336 bp, Homo sapiens
gatttagattgtcactgccaccctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaattttgtgcaccgagggcggcctgagcctctggatcttcacttgggcatgttcctgcccaccttgcttcaccaggcaactgcggagcagcaggagcgcttcttcatgcccgcctggaacttggagatcattggcacttatgcccagacagagatgggtcatggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagaccttaattgtcctttcagttgaaatctaatttatacaatcattctatacttaaaggttaaatacatcttaattaattttttcttaaagtca

SEQ ID NO: 285872 - DNA, 1772 bp, Homo sapiens
ttagttcatgctctgctcattgcacaggttaggataaactggtagtaacattgcttcctaatcatgtgttgagaagtcgtgaagatcagttagatgagatgtattttgtactttaaactttttagatacgagctttgtcaaagtacaaaattgatccctataaaatctatgacacagcacagccaaggccaactactgtggattctgttttgtaagaagagagttgaggactaaatttcaatgtgatgtagagttaatccgtagtaatgttcattgaccattggggataaatttttacatgcccacattacttattgtaaaccctgaagacctttagcgatgtatgattctgccctggaatatgtatttactcttttggatatttgcttatattatctagggaaacatagttgaaattatttcttccttggagctcttgttaacagcgctataaataagtgttctatggagttatttttgctctttgaaacaaacaggtaaaacctaaataaagcaaaaaaaaaaaaccacacacattctaaaaaattcaaccaatcaaaccagcaaataacaccaacaacctccccttccaaaaattagagaagtttttatgctaaaacttaggtagaatttgcttagtggattaaatgtaaatacgaaatgaactgtgggaactgtggccttgaaataattagaagaagagagatcatcaggttctgctgctggctttttaggtagtaaaatggtaaatcttatatttaatttcataagaagggggtttacattttcctgaccttctccttgaaggccaaagctgtttggcaagaaggggttgtaggatgcagtttctaaaggaaggctgagatccttttctcttctctcctgtagactacatttggtcaattttgtggaacctgtgggcctcaattactccatgtttattcctaccttgctgaatcagggcaccactgctcagaaagagaaatggctgctttcatccaaaggactccagataattggcacctacgcccagacggaaatgggccacggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccagggtaaggatagggtcctagatgggctcagtaccaaaggcctagtttttaccccattcagatcccagaattcccaaatgtcaatacagaagatgcattagcactgcaaaattggctagggtgataactgggcctgtaatttcatatctaggcttccttttcttaagaggaaagacagaaataaccacccttgctataatcagtgactgcca

SEQ ID NO: 285873 - DNA, 1366 bp, Homo sapiens
ttagttcatgctctgctcattgcacaggttaggataaactggtagtaacattgcttcctaatcatgtgttgagaagtcgtgaagatcagttagatgagatgtattttgtactttaaactttttagatacgagctttgtcaaagtacaaaattgatccctataaaatctatgacacagcacagccaaggccaactactgtggattctgttttgtaagaagagagttgaggactaaatttcaatgtgatgtagagttaatccgtagtaatgttcattgaccattggggataaatttttacatgcccacattacttattgtaaaccctgaagacctttagcgatgtatgattctgccctggaatatgtatttactcttttggatatttgcttatattatctagggaaacatagttgaaattatttcttccttggagctcttgttaacagcgctataaataagtgttctatggagttatttttgctctttgaaacaaacaggtaaaacctaaataaagcaaaaaaaaaaaaccacacacattctaaaaaattcaaccaatcaaaccagcaaataacaccaacaacctccccttccaaaaattagagaagtttttatgctaaaacttaggtagaatttgcttagtggattaaatgtaaatacgaaatgaactgtgggaactgtggccttgaaataattagaagaagagagatcatcaggttctgctgctggctttttaggtagtaaaatggtaaatcttatatttaatttcataagaagggggtttacattttcctgaccttctccttgaaggccaaagctgtttggcaagaaggggttgtaggatgcagtttctaaaggaaggctgagatccttttctcttctctcctgtagactacatttggtcaattttgtggaacctgtgggcctcaattactccatgtttattcctaccttgctgaatcagggcaccactgctcagaaagagaaatggctgctttcatccaaaggactccagataattggcacctacgcccagacggaaatgggccacggttagtccacattgagggtctgtgggtaacccacctcaggacatcagttaacagtgattgctggcatttgacttttttctgctgctacctgtttgggattctatttttaagttgttaagtcaaaattcaacttcttgttttctcctagacattttccctggaaactggtccagggctctggcctataaacgtcattcactgttatttcctaaagccttttattattgaacagcttgaaaagatggggtttacagtgcagcggggaaccccattatgttactctgggtctaatgagtaaagactttgttggaaattct

SEQ ID NO: 285874 - DNA, 201 bp, Homo sapiens
gatctggccattgcactccatccagcctaggcaacaagaatgaaactccatctcaaaagaaacaaaagaaagtagagttactaaaagcatgtttactggtgacttttaggttcctgatgaaaagttatgatcaggtgcactcaggaaagttggtgtgtggcatggtgtcctatttgaacgacctgcccagtcagcgcatcc

SEQ ID NO: 285875 - DNA, 1962 bp, Homo sapiens
aggtctcacagcagacggtgccgacgcagcggtgttgcacctccctctccggctctgctgcccgggatttccccagaacctgcgccgcgcgagaaggagcctgggagcatccgcccacactgcccggacagtcggctcgactcggtgctctcggccccagccgggctccgctcctcgggcgcgcgaggggccgtggtggcggcggcgcccggcatgtttcatagtccgcggcggctctgctcggccctgctgcagagggacgcgcccggcctgcgccgcctgcccgccccagggctgcgccgcccgttgtccccgccggctgctgttcccaggcccgcatccccccggctgctggcggcggcctcggcggcctcgggcgccgcgaggtcgtgttcccgaacagtgtgttccatgggaaccggtacaagcagactctatagtgctctcgccaagacactgaacagcagcgctgcctcccagcacccagagtatttggtgtcacctgacccagagcatctggagcccattgatcctaaagagcttcttgaggaatgcagggccgtcctgcacacccgacctccccggttccagagggattttgtggatctgaggacagattgccctagtacccacccacctatcagggttatgcaatggaacatcctcgcccaagctcttggagaaggcaaagacaactttgtacagtgccctgttgaagcactcaaatgggaagaaaggaaatgtctcatcctggaagaaatcctggcctaccagcctgatatattgtgcctccaagaggtggaccactattttgacaccttccagccactcctcagtagactaggctatcaaggcacgtttttccccaaaccctggtcaccttgtctagatgtagaacacaacaatggaccagatggttgtgccttattttttcttcaaaaccgattcaagctagtcaacagtgccaatattaggctgacagccatgacattgaaaaccaaccaggtggccattgcacagaccctggagtgcaaggagtcaggccgacagttctgcatcgctgttacccatctaaaagcacgcactggctgggagcggtttcgatcagctcaaggctgtgacctccttcagaacctgcaaaacatcacccaaggagccaagattccccttattgtgtgtggggacttcaatgcagagccaacagaagaggtctacaaacactttgcttcctccagcctcaacctgaacagcgcctacaagctgctgagtgctgatgggcagtcagaacccccatacactacctggaagatccggacctcaggggagtgcaggcacaccctggattacatctggtattctaaacatgctctaaatgtaaggtcagctctcgatctgctcactgaagaacagattggacccaacaggttaccttccttcaattatccttcagaccacctgtctctagtgtgtgacttcagctttactgaggaatctgatggactttcataaatacttgcttttgtctttttaatcacaggagtctatttttttttttttttttttttgagacagagtctcgctctgttgcctaggcggagtacagtggcctgatctcggctcactgcaagatccgcctcccgggttcatggcattctcctgcctcagcctccagggcaactgggacaacaggcgcccgtcaccacgcccagctaattttttgtatttttagtagagacggggtttcaccgtgttagccaggatggtctcgatctcctgacctgaatcacaagagtcttaacagggaatgtttcaggaaacaaataggataagacaatgccagaggaaggatagaaacatgggaagtttctatcatttcattttctgcgtttccagcatgctccttggaaaagactccctttagtccctttttcaattaaaacctatggtgaaaaaggcgtttgc

SEQ ID NO: 285876 - DNA, 1393 bp, Homo sapiens
  misc_feature (103)..(103): n is a, c, g, or t
tttttttttttcctggaaaataaggggagattccgtgacttaccaatctttgattctttttccctaagtaggaaaagctgcctatttaaaataagttccattnattctgagtagtgtccataatagtcagggttaaaactaatacttggtgttaaatatttggtgtttaaaaaaaccaaaaaaattttaaaagaaaattggcatttatttcattttatatagcttagatccctggcactgcaaagcagtttccttaagtaagatcttaatatcctggaatatagttaacatgaaatcatttcgaaacaaaagatctgttgtttgcttcatccacatagtgagaggtgatttagtttggatggggtaatacagtttggacagagagccactccaagcatttaaagcagaggaagcattctgagggtcttgagtgatgccaaacctcctgggtactttgaagtcacggttttgtaagagctgacaactgactagctttttcttttcagctcttggagaaggcaaagacaactttgtacagtgccctgttgaagcactcaaatgggaagaaaggaaatgtctcatcctggaagaaatcctggcctaccagcctgatatattgtgcctccaagaggtggaccactattttgacaccttccagccactcctcagtagactaggctatcaaggcacgtttttccccaaaccctggtcaccttgtctagatgtagaacacaacaatggaccagatggttgtgccttattttttcttcaaaaccgattcaagctagtcaacagtgccaatattaggctgacagccatgacattgaaaaccaaccaggtggccattgcacagaccctggagtgcaaggagtcaggccgacagttctgcatcgctgttacccatctaaaagcacgcactggctgggagcggtttcgatcagctcaaggctgtgacctccttcagaacctgcaaaacatcacccaaggagccaagattccccttattgtgtgtggggacttcaatgcagagccaacagaagaggtctacaaacactttgcttcctccagcctcaacctgaacagcgcctacaagctgctgagtgctgatgggcagtcagaacccccatacactacctggaagatccggacctcaggggagtgcaggcacaccctggattacatctggtattctaaacatgctctaaatgtaaggtcagctctcgatctgctcactgaagaacagattggacccaacaggttaccttccttcaattatccttcagaccacctgtctctagtgtgtgacttcagctttactgaggaatctgatggactttcataaatacttgcttttgtctttttctcgtgccgaattcttgcctcgagggggccc

SEQ ID NO: 285877 - DNA, 815 bp, Homo sapiens
ccgtctagtcgaggcctgggtttgaatcggccgaggagcggtgttgcacctccctctccggctctgctgcccgggatttccccagaacctgcgccgcgcgagaaggagcctgggagcatccgcccacactgcccggacagtcggctcgactcggtgctctcggccccagccgggctccgctcctcgggcgcgcgaggggccgtggtggcggcggcgcccggcatgtttcatagtccgcggcggctctgctcggccctgctgcagagggacgcgcccggcctgcgccgcctgcccgccccagggctgcgccgcccgttgtccccgccggctgctgttcccaggcccgcatccccccggctgctggcggcggcctcggcggcctcgggcgccgcgaggtcgtgttcccgaacagtgtgttccatgggaaccggtacaagcagactctatagtgctctcgccaagacactgaacagcagcgctgcctcccagcacccagagtatttggtgtcacctgacccagagcatctggagcccattgatcctaaagagcttcttgaggaatgcagggccgtcctgcacacccgacctccccggttccagagggattttgtggatctgaggacagattgccctagtacccacccacctatcagggttatgcaatggaacatcctcgcccaaggtatgctggatgcttttgtgcctctgcagtcaagtttgctgtgactgcctttctgcttctgcacatccacagtgcactgttttatgtggaaggaagaggtgtgggcagatggaggtgactgcagcagcatgga

SEQ ID NO: 285878 - DNA, 648 bp, Homo sapiens
  misc_feature (117)..(117): n is a, c, g, or t
gatctcaaactccttggctcaagtgatctgcccacctcagcctcccagagtgctgggattacaggcgtgagccactgtgcccggctcatgttctcctatttaaaataagttccattnattctgagtagtgtccataatagtcagggttaaaactaatacttggtgttaaatatttggtgtttaaaaaaaccaaaaaaattttaaaagaaaattggcatttatttcattttatatagcttagatccctggcactgcaaagcagtttccttaagtaagatcttaatatcctggaatatagttaacatgaaatcatttcgaaacaaaagatctgttgtttgcttcatccacatagtgagaggtgatttagtttggatggggtaatacagtttggacagagagccactccaagcatttaaagcagaggaagcattctgagggtcttgagtgatgccaaacctcctgggtactttgaagtcacggttttgtaagagctgacaactgactagctttttcttttcagctcttggagaaggcaaagacaactttgtacagtgccctgttgaagcactcaaatgggaagaaaggaaatccctctcctacattatatcccgctgccactacgctagctcgatgctccgtcactattca

SEQ ID NO: 285879 - DNA, 358 bp, Homo sapiens
tcaaacgtcactgtttatttcacatttaaaatataaaatataccatggtgtccctgtgagtttgctgtggttccctgggacacgttagctcacaatttggggatcacaatcccaggtgatgctgatattgctgatcaggagaccacacttggatgtttggctgttttttgtttgttttccccaaaaaacctatcagggttatgcaatggaacatcctcgcccaaggtatgctggatgcttttgtgcctctgcagtcaagtttgctgtgactgcctttctgcttctgcacatccacagtgcactgttttatgtggaaggaagaggtgtgggcagatggaggtgactgcagcagcatgga

SEQ ID NO: 285880 - DNA, 570 bp, Homo sapiens
tggcatccgcattcccgtggtcataatatttgccatgatcttcagtatgatcttgtcctgtgctatccccaggaaccccgagatggtctaaaatcactttacatccctgagcaggaaagtttacccatgaaaattggtcggaatttttttttcatttttaggttttgctttttcacatttttatttcagaggattgtgctagaaaagcccagcttgtggaaatgatttgtcagccaatagacaattgagcaccagtcgaacatgttaaactaagcatttatcatggaggggattcccttctctttagagagcttttccatatgagtctgtcctggctgaaggtatggttcagtcttgtctggatgacgcttcagctttcttgtctggtctgtgactgccacctatcagggttatgcaatggaacatcctcgcccaaggtatgctggatgcttttgtgcctctgcagtcaagtttgctgtgactgcctttctgcttctgcacatccacagtgcactgttttatgtggaaggaagaggtgtgggcagatggaggtgactgcagcagcatgga

SEQ ID NO: 285881 - DNA, 578 bp, Homo sapiens
tggcatccgcattcccgtggtcataatatttgccatgatcttcagtatgatcttgtcctgtgctatccccaggaaccccgagatggtctaaaatcactttacatccctgagcaggaaagtttacccatgaaaattggtcggaatttttttttcatttttaggttttgctttttcacatttttatttcagaggattgtgctagaaaagcccagcttgtggaaatgatttgtcagccaatagacaattgagcaccagtcgaacatgttaaactaagcatttatcatggaggggattcccttctctttagagagcttttccatatgagtctgtcctggctgaaggtatggttcagtcttgtctggatgacgcttcagctttcttgtctggtctgtgactgccacctggcaaagagaggttgtttggattgtcacactcagtctaggtgcttgtatttttagacacgttaggttgagagttctgaccttcacttgatatctctggtaatgccaagcgggtcgtggcactgctttgtacactctgtgctgtggcagtgtgtgtgtgctgtgacgacagtgacg

SEQ ID NO: 285882 - DNA, 1587 bp, Homo sapiens
aggggaagccgcgtggtgtgcgaccctgggcgttgagctccaggcttcctggcaaagaggactgtggattcctggccctgtgaccttgggcaaaaaaatgaggaagattcataagtaagttaacacagaattaccaaaaacctcatgagaaagaaatgaagggatgtttcagggtagcttttcgagtcccaagtgatcattgatttggcccttctgtttctgattgtgaaaaagcattctgaaagaatgggcgccggttcaagaggaggtctctgagggtcagcctttggctgtttatagagaaatcagataaaaactacttggtgaaatgacttcttgtcacattgctgaagaacatatacaaaaggttgctatctttggaggaacccatgggaatgagctaaccggagtatttctggttaagcattggctagagaatggcgctgagattcagagaacagggctggaggtaaaaccatttattactaaccccagagcagtgaagaagtgtaccagatatattgactgtgacctgaatcgcatttttgaccttgaaaatcttggcaaaaaaatgtcagaagatttgccatatgaagtgagaagggctcaagaaataaatcatttatttggtccaaaagacagtgaagattcctatgacattatttttgaccttcacaacaccacctctaacatggggtgcactcttattcttgaggattccaggaataactttttaattcagatgtttcattacattaagacttctctggctccactaccctgctacgtttatctgattgagcatccttccctcaaatatgcgaccactcgttccatagccaagtatcctgtgggtatagaagttggtcctcagcctcaaggggttctgagagctgatatcttggatcaaatgagaaaaatgattaaacatgctcttgattttatacatcatttcaatgaaggaaaagaatttcctccctgcgccattgaggtctataaaattatagagaaagttgattacccccgggatgaaaatggagaaattgctgctatcatccatcctaatctgcaggatcaagactggaaaccactgcatcctggggatcccatgtttttaactcttgatgggaagacgatcccactgggcggagactgtaccgtgtaccccgtgtttgtgaatgaggccgcatattacgaaaagaaagaagcttttgcaaagacaactaaactaacgctcaatgcaaaaagtattcgctgctgtttacattagaaatcacttccagcttacatcttacacggtgtcttacaaattctgctagtctgtaagctccttaagagtagggttgtgccttattcaactgcatacatagctcctagcacagtgccttattcggtaggcatctaagcaaatttcttaaattaattaatatatctttaaagatatcatattttatgtatgtagcttattcaaagaagtgtttcctatttctatatagtttattatacatgatacttgggtagctcaacattcttaataaacagcctttgtattcagaatataaaattgaaatagatatatataaagtt

SEQ ID NO: 285883 - DNA, 1437 bp, Homo sapiens
  misc_feature (1384)..(1384): n is a, c, g, or t
ttgtaacagaaaattaaaatatactccactcaagggaattctgtactttgccctttgggtaaagtctcatttacatttctaaacctttcttaagaaaatcgaatttcctttgatctctcttctgaattgcagaaatcagataaaaactacttggtgaaatgacttcttgtcacattgctgaagaacatatacaaaaggttgctatctttggaggaacccatgggaatgagctaaccggagtatttctggttaagcattggctagagaatggcgctgagattcagagaacagggctggaggtaaaaccatttattactaaccccagagcagtgaagaagtgtaccagatatattgactgtgacctgaatcgcatttttgaccttgaaaatcttggcaaaaaaatgtcagaagatttgccatatgaagtgagaagggctcaagaaataaatcatttatttggtccaaaagacagtgaagattcctatgacattatttttgaccttcacaacaccacctctaacatggggtgcactcttattcttgaggattccaggaataactttttaattcagatgtttcattacattaagacttctctggctccactaccctgctacgtttatctgattgagcatccttccctcaaatatgcgaccactcgttccatagccaagtatcctgtgggtatagaagttggtcctcagcctcaaggggttctgagagctgatatcttggatcaaatgagaaaaatgattaaacatgctcttgattttatacatcatttcaatgaaggaaaagaatttcctccctgcgccattgaggtctataaaattatagagaaagttgattacccccgggatgaaaatggagaaattgctgctatcatccatcctaatctgcaggatcaagactggaaaccactgcatcctggggatcccatgtttttaactcttgatgggaagacgatcccactgggcggagactgtaccgtgtaccccgtgtttgtgaatgaggccgcatattacgaaaagaaagaagcttttgcaaagacaactaaactaacgctcaatgcaaaaagtattcgctgctgtttacattagaaatcacttccagcttacatcttacacggtgtcttacaaattctgctagtctgtaagctccttaagagtagggttgtgccttattcaactgcatacatagctcctagcacagtgccttattcggtaggcatctaagcaaatttcttaaattaattaatatatctttaaagatatcatattttatgtatgtagcttattcaaagaagtgtttcctatttctatatagtttattatacatgatacttgggtagctcaacattcttaataaacagcctttgtattcnaaaaaaaacccccccttaaccctcccttccttttcctcctcccacatcgccct

SEQ ID NO: 285884 - DNA, 345 bp, Homo sapiens
gctggggacagagctgaagcccaggttcagatggcggccatggaaggcggagagccgtcagcgaggcagcgccggggctgcgggagcttgcgggagggaagcgcccgtgagccgcagagacgctctgcaggggaagccgcgtggtgtgcgaccctgggcgttgagctccaggcttcctggcaaagaggactgtggattcctggccctgtgaccttgggcaagttacttactgaacaccctctggacctaccagtaaaagaacaataacaacaatcgccctaaaaatactagaagatgaaatagacaatcctggcacacagtaaatgcccagtaactgttagccct

SEQ ID NO: 285885 - DNA, 435 bp, Homo sapiens
aacagaatactgtaatttgttagttgtctagagtctgacataaatttttagaggagaaaaaccaaatataatatatttattttgattgtttcctgagaggatcaagactggaaaccactgcatcctggggatcccatgtttttaactcttgatgggaagacgatcccactgggcggagactgtaccgtgtaccccgtgtttgtgaatgaggccgcatattacgaaaagaaagaagcttttgcaaagacaactaaactaacgctcaatgcaaaaagtattcgctgctgtttacattagaaatcacttccagcttacatcttacacggtgtcttacaaattctgctagtctgtaagctccttaagagtagggttgtgccttattcaactgcatacatagctcctagcacagtgccttattcggtaggcatctaagca

SEQ ID NO: 285886 - DNA, 1417 bp, Homo sapiens
ttgtaacagaaaattaaaatatactccactcaagggaattctgtactttgccctttgggtaaagtctcatttacatttctaaacctttcttaagaaaatcgaatttcctttgatctctcttctgaattgcagaaatcagataaaaactacttggtgaaatgacttcttgtcacattgctgaagaacatatacaaaaggttgctatctttggaggaacccatgggaatgagctaaccggagtatttctggttaagcattggctagagaatggcgctgagattcagagaacagggctggaggtaaaaccatttattactaaccccagagcagtgaagaagtgtaccagatatattgactgtgacctgaatcgcatttttgaccttgaaaatcttggcaaaaaaatgtcagaagatttgccatatgaagtgagaagggctcaagaaataaatcatttatttggtccaaaagacagtgaagattcctatgacattatttttgaccttcacaacaccacctctaacatggggtgcactcttattcttgaggattccaggaataactttttaattcagatgtttcattacattaagacttctctggctccactaccctgctacgtttatctgattgagcatccttccctcaaatatgcgaccactcgttccatagccaagtatcctgtgggtatagaagttggtcctcagcctcaaggggttctgagagctgatatcttggatcaaatgagaaaaatgattaaacatgctcttgattttatacatcatttcaatgaaggaaaagaatttcctccctgcgccattgaggtctataaaattatagagaaagttgattacccccgggatgaaaatggagaaattgctgctatcatccatcctaatctgcaggatcaagactggaaaccactgcatcctggggatcccatgtttttaactcttgatgggaagacgatcccactgggcggagactgtaccgtgtaccccgtgtttgtgaatgaggccgcatattacgaaaagaaagaagcttttgcaaagacaactaaactaacgctcaatgcaaaaagtattcgctgctgtttacattagaaatcacttccagcttacatcttacacggtgtcttacaaattctgctagtctgtaagctccttaagagtagggttgtgccttattcaactgcatacatagctcctagcacagtgccttattcggtaggcatctaagcaaatttcttaaattaattaatatatctttaaagatatcatattttatgtatgtagcttattcaaagaagtgtttcctatttctatatagtttattatacatgatacttgggtagctcaacattcttaataaacagcctttgtattcagaatataaaattgaaatagatatatataaagtt

SEQ ID NO: 285887 - DNA, 1735 bp, Homo sapiens
  misc_feature (1735)..(1735): n is a, c, g, or t
ttgtaacagaaaattaaaatatactccactcaagggaattctgtactttgccctttgggtaaagtctcatttacatttctaaacctttcttaagaaaatcgaatttcctttgatctctcttctgaattgcagaaatcagataaaaactacttggtgaaatgacttcttgtcacattgctgaagaacatatacaaaaggttgctatctttggaggaacccatgggaatgagctaaccggagtatttctggttaagcattggctagagaatggcgctgagattcagagaacagggctggaggtaaaaccatttattactaaccccagagcagtgaagaagtgtaccagatatattgactgtgacctgaatcgcatttttgaccttgaaaatcttggcaaaaaaatgtcagaagatttgccatatgaagtgagaagggctcaagaaataaatcatttatttggtccaaaagacagtgaagattcctatgacattatttttgaccttcacaacaccacctctaacatggggtgcactcttattcttgaggattccaggaataactttttaattcagatgtttcattacattaagacttctctggctccactaccctgctacgtttatctgattgagcatccttccctcaaatatgcgaccactcgttccatagccaagtatcctgtgggtatagaagttggtcctcagcctcaaggggttctgagagctgatatcttggatcaaatgagaaaaatgattaaacatgctcttgattttatacatcatttcaatgaaggaaaagaatttcctccctgcgccattgaggtctataaaattatagagaaagttgattacccccgggatgaaaatggagaaattgctgctatcatccatcctaatctgcaggatcaagactggaaaccactgcatcctggggatcccatgtttttaactcttgatgggaagacgatcccactgggcggagactgtaccgtgtaccccgtgtttgtgaatgaggccgcatattacgaaaagaaagaagcttttgcaaagacaactaaactaacgctcaatgcaaaaagtattcgctgctgtttacattagaaatcacttccagcttacatcttacacggtgtcttacaaattctgctagtctgtaagctccttaagagtagggttgtgccttattcaactgcatacatagctcctagcacagtgccttattcggtaggcatctaagcaaatttcttaaattaattaatatatctttaaagatatcatattttatgtatgtagcttattcaaagaagtgtttcctatttctatatagtttattatacatgatacttgggtagctcaacattcttaataaacagcctttgtattcagaatataaaattgaaatagatatatataaagttatttgttttattgtgctttgccttactacacttcacggatactgtacttgtactttttttccaaattgaaggtttttggcaaccctgtgtctagaaagtctaacagtgccatgtttccaacagcatgtgctcactccttgtctctgtgtcaccctttgataatatttcaagcttttttatgatttatttattatatctgctatggtgaaaaaaaaaaaccataaaaaaatcactggccgcggtttacaacgtcgtgaatgggaatttggcgtacccaactttcgccttgcggacattccccttttgcaggttggggcn

SEQ ID NO: 285888 - DNA, 1690 bp, Homo sapiens
acgcagcgcggttgctgggcacctcgactatcacctgaccgtagtaatatctcccgctacgcgcgttgtgaccaatgctgcatacaggagatgagggaggacggccagacacctggaagccggaaaatggtgaaaggcaggattgggaaccccacagaccgcagctcctcccaggagaaccccacacatgagtctggatcctcgccatgatcctcccgtggcccccacacaatctggggagacgcggggccgcgggcactgcgctgccgagagggctccggactgaggctgcagttgctgcgcagggacggctcaggatgcccggggtcccggctgctggcccagccccaccctgtggccgaggggacccagggacgagctgcgccagggagactcgggtccgcagaccccggaatcgctgctgacaggcccgggtcccaccacagcaggtcccaaccagcccctcctcccacccggccttgcacactcaccatttcccggctcccaggtgtcccgggtcctcccttggctccggagatcagtgctggtcaccaccggacagaagctgtggtggagccacctcggcctctggaaggctgaattcagtgggttaggggaacaggagccccttagacttgcggagcttggccccaccctcctggcggagcgcctgattggataatttacacgaccccgcccagtacccctaggataggaatcaagccccaccccctaggcccgggtttcaggagaagccacggaaaactcggaagtgtggagcaggattgacaggttctagcaacagccctcccacccccccgcccaggccaggcttccttctggagcttggacgtgaccccacactggggacatttgcatttaagaaaaacttggctccaggctttccacagtgggccctggcatcttcctatactcactgggccctttctgtttcttccttctggacgggggttcacaagtgtgagcaggcagttccacactccgtgtccaattgagccagtacctttgctggaagctactgggctggaacaggagggagagcccagatgtcttccagggatcaggaatttgggataagcggctggtggcatggccaaggcttcctcataccttatctcagtctacccattttcagggaagaaaatgaaatatgccaacaagggaacaaaaattaagtgcatggaaaaaagttatactacagcaatattctgtaaagaaatcaaaaggggccgggcgcgatggctcaccctataatcccagcactttgggaggccaaggtagggcagatcacatgaggtcaggagttcaaggaccatcctggctaacacagtgaaaccctgtctctactaaaaatacaaaaaattagccgggcgtggtggtgggcacctgtagtcctagctactcgggaggctgaggcaggagaatagcgtgaacctgggaggcggagcttgcagtgagccgagattgcactactgcactccagcctgggtgacagagcgagactccggctcaaaaaaaaaaaaaaattaaaaactggccaggcacattggcacacggctcacacctgtaatcccagcacttcgagaggccaaggcaggaagatcccttgagcccaggaaacctgtctgggcaatatagtaagacctatatagtaagaccttgtctctcc

SEQ ID NO: 285889 - DNA, 710 bp, Homo sapiens
catgcttctacttacatgacgcacctagaatcagcaaattcatagagcaagaaaggaaaatagagattaccaagggatggggatgggaggaatagggaatggttgtttaatgggtaccaatttttttttggactaatgaaaaaattctggaactagctagctagctgtgatggttctaaagcactgttaatgtatttaatgctactgaatggcatacttacaatggtaaattctatgttactatatttgaccttaaaaaaaattaaaggccgggtgcggtggctcacgcctgtaatcccagcactttgggaggccgaggtagggcagatcacatgaggtcaggagttcaaggaccatcctggctaacacagtgaaaccctgtctctactaaaaatacaaaaaattagccgggcgtggtggtgggcacctgtagtcctagctactcgggaggctgaggcaggagaatagcgtgaacctgggaggcggagcttgcagtgagccgagattgcactactgcactccagcctgggtgacagagcgagactccggctcaaaaaaaaaaaaaaattaaaaactggccaggcacattggcacacggctcacacctgtaatcccagcacttcgagaggccaaggcaggaagatcccttgagcccaggaaacctgtctgggcaatatagtaagacctatatagtaagaccttgtctctcc

SEQ ID NO: 285890 - DNA, 1757 bp, Homo sapiens
acgcagcgcggttgctgggcacctcgactatcacctgaccgtagtaatatctcccgctacgcgcgttgtgaccaatgctgcatacaggagatgagggaggacggccagacacctggaagccggaaaatgattcttcacggaaaaatccagcaaagcctactccttctggatgaagttcagagtcacatcttcaaagaccaccaagccgtgacatatcccagatatgtgtagaggaggacaggtgaaaggcaggattgggaaccccacagaccgcagctcctcccaggagaaccccacacatgagtctggatcctcgccatgatcctcccgtggcccccacacaatctggggagacgcggggccgcgggcactgcgctgccgagagggctccggactgaggctgcagttgctgcgcagggacggctcaggatgcccggggtcccggctgctggcccagccccaccctgtggccgaggggacccagggacgagctgcgccagggagactcgggtccgcagaccccggaatcgctgctgacaggcccgggtcccaccacagcaggtcccaaccagcccctcctcccacccggccttgcacactcaccatttcccggctcccaggtgtcccgggtcctcccttggctccggagatcagtgctggtcaccaccggacagaagctgtggtggagccacctcggcctctggaaggctgaattcagtgggttaggggaacaggagccccttagacttgcggagcttggccccaccctcctggcggagcgcctgattggataatttacacgaccccgcccagtacccctaggataggaatcaagccccaccccctaggcccgggtttcaggagaagccacggaaaactcggaagtgtggagcaggattgacaggttctagcaacagccctcccacccccccgcccaggccaggcttccttctggagcttggacgtgaccccacactggggacatttgcatttaagaaaaacttggctccaggctttccacagtgggccctggcatcttcctatactcactgggccctttctgtttcttccttctggacgggggttcacaagtgtgagcaggcagttccacactccgtgtccaattgagccagtacctttgctggaagctactgggctggaacaggagggagagcccagatgtcttccagggatcaggaatttgggataagcggctggtggcatggccaaggcttcctcataccttatctcagtctacccattttcagggaagaaaatgaaatatgccaacaagggaacaaaaattaagtgcatggaaaaaagttatactacagcaatattctgtaaagaaatcaaaaggggccgggcgcgatggctcaccctataatcccagcactttgggaggccaaggtaggaggatcacctgaggtcaggagtttgagaccgctctggccaacatggtgaaaccccattctctactaaaaatacaaaaactaggccaggcgcggtagctcacgcctgtaatcctagcactttgggaggccaaggcgggcggaccacaaggtcaagagatcaagactatcctggccaacatggtgaaaccctgtctctactaaaaataccaaaaaaatcagctgggcgtggtggcacgtgcctgtagtcagagcagctcgggaggttgaggcagtagaattgcctgaacccgggagacagaggttgcagtgagccaagatcacaccactgcactccagcctggc

SEQ ID NO: 285891 - DNA, 954 bp, Homo sapiens
gacgtcattgagctgcgacccttgttcaacgccgttggcgaagccagctgctggaggtgccgagaatctgagtttcggcaagcagccaggtctggaaactgtaacaggacattcagttagtaatgatggttgcaggttgaatagtctcgccctagatctcacctaacttgcagaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattacta

SEQ ID NO: 285892 - DNA, 1428 bp, Homo sapiens
gacgtcattgagctgcgacccttgttcaacgccgttggcgaagccagctgctggaggtgccgagaatctgagtttcggcaagcagccaggtctggaaactgatttggagtggatcagttacgagatgacaatctagaaacttattggcaatcagatggttcccagcctcatttagtgaacatccaattcagcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattactataaaaatggatttgaagccaatcattttattttcccttgtatcaaaagaaaagagttccttgtatcaaaagaaaagagttgaactgaaaatttcagtatatacacaattataatagctaggtgattatttcattagtgttcatacattagagtaatggtttattgcatatttgagaacaagactgtgttttatcaatatatatcatctttaataggtcaaaattactattttttctacccagaggaaggttattcttttaatactggatcttttaaaaaacagtgtcaaataagcttagtgttaggttgtctgatgagaaccaatctaatatggggagtataattaattgtctcatattcaccttcacggaatacttacagccctagggttgtctgtatcctaatgatattatgtaaagattgcctgtataatctagcagtacttatggaagagttctagcagtacttatggaagagttattttcaaatttgtgtctgacattgtagcattccctgggcagtcatatatcccataaaatcgtaaaagtatgtgaaattttttatatatattaaaagattttaaagaaatacatggaaatgtggttttttccatggtttaaaatgagtagatttgattttgtatgctgttttctctagatgtattactttttttcgggggatggttatttagccacagaatttacctagattcactcttgtttggaaaagattgctctctgtggttcatgcattgctgggtacactaaagtattaaatagtgaatattatttaaaa

SEQ ID NO: 285893 - DNA, 491 bp, Homo sapiens
cggcgaattgcgcacagggaggagggtgtcgagttgcagccctcccttgcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattacta

SEQ ID NO: 285894 - DNA, 495 bp, Homo sapiens
  misc_feature (38)..(39): n is a, c, g, or t
  misc_feature (42)..(43): n is a, c, g, or t
ccggagcgcccgccctgcccgcccggctccgtttttgnnggnngtttcgggaccaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattacta

SEQ ID NO: 285895 - DNA, 486 bp, Homo sapiens
ttgtaaagagaaacatttattgtggtgttattaacaaacattcacaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattacta

SEQ ID NO: 285896 - DNA, 758 bp, Homo sapiens
  misc_feature (129)..(129): n is a, c, g, or t
  misc_feature (154)..(154): n is a, c, g, or t
atacttatctatacacttcaacttactttttcttcctcgaaaaactgcccggttccggctctaggtgaggtagatgctggcctcatcaaatgagcaacttgagttggtggaaccaagtggctggattcntgttcccttaactgacaatcataanaagccaactcgtacattcatgatacagattgctgttctagccaatcaccagaatggaagagacacccatatgagacaaattagaatatacacaccagtagaagagagctccattgcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattactattctcacatcaaaaaaaaaaaacaatggtctcgctggcctcagcgtg

SEQ ID NO: 285897 - DNA, 516 bp, Homo sapiens
  misc_feature (52)..(52): n is a, c, g, or t
  misc_feature (89)..(90): n is a, c, g, or t
  misc_feature (93)..(93): n is a, c, g, or t
gagggagggccagttcctggaccggaggcctttcggtcctttcccccagaangatttctgtttactatgagtccgcccgtcgaggcaannggnatgaaaaccggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattacta

SEQ ID NO: 285898 - DNA, 502 bp, Homo sapiens
  misc_feature (25)..(25): n is a, c, g, or t
  misc_feature (47)..(47): n is a, c, g, or t
  misc_feature (51)..(52): n is a, c, g, or t
  misc_feature (70)..(70): n is a, c, g, or t
gggtgggcccggcttttggatgggnggggtttgggtattttaaaaanaatnngtgctgtgtactatgagntgtgctttttaaccgagaggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattacta

SEQ ID NO: 285899 - DNA, 936 bp, Homo sapiens
gacgtcattgagctgcgacccttgttcaacgccgttggcgaagccagctgctggaggtgccgagaatctgagtttcggcaagcagccaggtctggaaactaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattactaaaccaacaaaccttacatgctgattaaaaactacccaatggccttgttggcctca

SEQ ID NO: 285900 - DNA, 1257 bp, Homo sapiens
gacgtcattgagctgcgacccttgttcaacgccgttggcgaagccagctgctggaggtgccgagaatctgagtttcggcaagcagccaggtctggaaactctgtgagtgtgtgggcttttctccgacgtcgagcgtggtcctagcgtaaacagatgcattcgcctctccggtttcaatctttttttacgtttgcgctttcctcaaggccggtgggtcaggagtggagccttagtcattctaacgctggaggtgtcagtaggaccaacagagtctggtgccgacacggcttactgttgcgcgctcttctaggcctcaacttcctctcaactgtgtggtaacaggacattcagttagtaatgatggttgcaggttgaatagtctcgccctagatctcacctaacttgcagtaagtatcaagtgcttgtgtgccgattaaagaacaacttcggatacaatgggaggtgtcaaggaaacgaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattacta

SEQ ID NO: 285901 - DNA, 921 bp, Homo sapiens
gttttttcacatatgaatagacttagtaaaattaacaaaagatgtgaaagatgaggtcaacctttttagaatgggccagttattcacttcaaaatcttgaagccattttcctgaccttatcttctatggtaagagcatataatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattacta

SEQ ID NO: 285902 - DNA, 833 bp, Homo sapiens
ccaagaatgtcggcacgaggctgagttttgtaatcagccaggtctggaaactaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattacta

SEQ ID NO: 285903 - DNA, 1315 bp, Homo sapiens
gacgtcattgagctgcgacccttgttcaacgccgttggcgaagccagctgctggaggtgccgagaatctgagtttcggcaagcagccaggtctggaaactctgtgagtgtgtgggcttttctccgacgtcgagcgtggtcctagcgtaaacagatgcattcgcctctccggtttcaatctttttttacgtttgcgctttcctcaaggccggtgggtcaggagtggagccttagtcattctaacgctggaggtgtcagtaggaccaacagagtctggtgccgacacggcttactgttgcgcgctcttctaggcctcaacttcctctcaactgtgtggtcagttcagggccgggaatccaatcttttccgagctccatattttatccacttggtggcgtccagtcccaagtccggcagttgaattctgccctaaagatgggctttatttctatctttttttaggtaacaggacattcagttagtaatgatggttgcaggttgaatagtctcgccctagatctcacctaacttgcagaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattacta

SEQ ID NO: 285904 - DNA, 1211 bp, Homo sapiens
gacgtcattgagctgcgacccttgttcaacgccgttggcgaagccagctgctggaggtgccgagaatctgagtttcggcaagcagccaggtctggaaactaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcgggtggcagcgttcctccctctgaaactaagacgtctaggccagcagaacgtaatgtcgtgggaacaggaagcaaaaatgttgccagtggatcaccaggggtgatggtggtaccattttcacttccaccccttgattcctggaactgtgaatcctggctatgggagaaactgtaccatatattggaccctgattcagagcatacacagccttctggagaactttgccccagtcctgcaaagtattgtcatctagttggcattgtgattgtgacttcaaaaggctattccaccattctgtctatccagctgcttcaggatgatggggaacatgcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattacta

SEQ ID NO: 285905 - DNA, 1506 bp, Homo sapiens
  misc_feature (129)..(129): n is a, c, g, or t
  misc_feature (154)..(154): n is a, c, g, or t
atacttatctatacacttcaacttactttttcttcctcgaaaaactgcccggttccggctctaggtgaggtagatgctggcctcatcaaatgagcaacttgagttggtggaaccaagtggctggattcntgttcccttaactgacaatcataanaagccaactcgtacattcatgatacagattgctgttctagccaatcaccagaatggaagagacacccatatgagacaaattagaatatacacaccagtagaagagagctccattgcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattactataaaaatggatttgaagccaatcattttattttcccttgtatcaaaagaaaagagttccttgtatcaaaagaaaagagttgaactgaaaatttcagtatatacacaattataatagctaggtgattatttcattagtgttcatacattagagtaatggtttattgcatatttgagaacaagactgtgttttatcaatatatatcatctttaataggtcaaaattactattttttctacccagaggaaggttattcttttaatactggatcttttaaaaaacagtgtcaaataagcttagtgttaggttgtctgatgagaaccaatctaatatggggagtataattaattgtctcatattcaccttcacggaatacttacagccctagggttgtctgtatcctaatgatattatgtaaagattgcctgtataatctagcagtacttatggaagagttctagcagtacttatggaagagttattttcaaatttgtgtctgacattgtagcattccctgggcagtcatatatcccataaaatcgtaaaagtatgtgaaattttttatatatattaaaagattttaaagaaatacatggaaatgtggttttttccatggtttaaaatgagtagatttgattttgtatgctgttttctctagatgtattactttttttcgggggatggttatttagccacagaatttacctagattcactcttgtttggaaaagattgctctctgtggttcatgcattgctgggtacactaaagtattaaatagtgaatattatttaaaa

SEQ ID NO: 285906 - DNA, 1516 bp, Homo sapiens
ccatggcagtaggaagacatgtaaacagttttgtacttaatatttgacatgttttttattgatgaattacttcctttttttaatgtaagctttgtttatgctgcagttaatactgtaaatcagtgcatgcctagcgggttacatctgctcttaagtaagtcacagccagagtagatagtgacttaaaggttgctaataggaagcagaagatccagaagccagactgagagatgtcgatgtcttcatagagaaactctaatggatcctgtttacaccactcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattactataaaaatggatttgaagccaatcattttattttcccttgtatcaaaagaaaagagttccttgtatcaaaagaaaagagttgaactgaaaatttcagtatatacacaattataatagctaggtgattatttcattagtgttcatacattagagtaatggtttattgcatatttgagaacaagactgtgttttatcaatatatatcatctttaataggtcaaaattactattttttctacccagaggaaggttattcttttaatactggatcttttaaaaaacagtgtcaaataagcttagtgttaggttgtctgatgagaaccaatctaatatggggagtataattaattgtctcatattcaccttcacggaatacttacagccctagggttgtctgtatcctaatgatattatgtaaagattgcctgtataatctagcagtacttatggaagagttctagcagtacttatggaagagttattttcaaatttgtgtctgacattgtagcattccctgggcagtcatatatcccataaaatcgtaaaagtatgtgaaattttttatatatattaaaagattttaaagaaatacatggaaatgtggttttttccatggtttaaaatgagtagatttgattttgtatgctgttttctctagatgtattactttttttcgggggatggttatttagccacagaatttacctagattcactcttgtttggaaaagattgctctctgtggttcatgcattgctgggtacactaaagtattaaatagtgaatattatttaaaa

SEQ ID NO: 285907 - DNA, 1622 bp, Homo sapiens
gacgtcattgagctgcgacccttgttcaacgccgttggcgaagccagctgctggaggtgccgagaatctgagtttcggcaagcagccaggtctggaaactaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattactataaaaatggatttgaagccaatcattttattttcccttgtatcaaaagaaaagagttccttgtatcaaaagaaaagagttgaactgaaaatttcagtatatacacaattataatagctaggtgattatttcattagtgttcatacattagagtaatggtttattgcatatttgagaacaagactgtgttttatcaatatatatcatctttaataggtcaaaattactattttttctacccagaggaaggttattcttttaatactggatcttttaaaaaacagtgtcaaataagcttagtgttaggttgtctgatgagaaccaatctaatatggggagtataattaattgtctcatattcaccttcacggaatacttacagccctagggttgtctgtatcctaatgatattatgtaaagattgcctgtataatctagcagtacttatggaagagttctagcagtacttatggaagagttattttcaaatttgtgtctgacattgtagcattccctgggcagtcatatatcccataaaatcgtaaaagtatgtgaaattttttatatatattaaaagattttaaagaaatacatggaaatgtggttttttccatggtttaaaatgagtagatttgattttgtatgctgttttctctagatgtattactttttttcgggggatggttatttagccacagaatttacctagattcactcttgtttggaaaagattgctctctgtggttcatgcattgctgggtacactaaagtattaaatagtgaatattatttaaaa

SEQ ID NO: 285908 - DNA, 1087 bp, Homo sapiens
gacgtcattgagctgcgacccttgttcaacgccgttggcgaagccagctgctggaggtgccgagaatctgagtttcggcaagcagccaggtctggaaactctgtgagtgtgtgggcttttctccgacgtcgagcgtggtcctagcgtaaacagatgcattcgcctctccggtttcaatctttttttacgtttgcgctttcctcaaggccggtgggtcaggagtggagccttagtcattctaacgctggaggtgtcagtaggaccaacagagtctggtgccgacacggcttactgttgcgcgctcttctaggcctcaacttcctctcaactgtgtggtcagttcagggccgggaatccaatcttttccgagctccatattttatccacttggtggcgtccagtcccaagtccggcagttgaattctgccctaaagatgggctttatttctatctttttttaggtaacaggacattcagttagtaatgatggttgcaggttgaatagtctcgccctagatctcacctaacttgcagaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcctcatgttttacatgtgaatgaagaatcaatgaatcttcaagtctcaggataaaggaatgagaatattgaagcagaaactgcaaataaaagacaatgcatacttttctgtgtccatttctccttcataaaggaattaagagaattcttcctacaaggatttgtagatatttgggaatctttcctcttgtatttgaaattatagttgatggtac

SEQ ID NO: 285909 - DNA, 414 bp, Homo sapiens
gttccttttcatggaggaggcacatactacttgtgtctagtcagccatctgtgtttcacatatttttaaaagttgtgagacatgtactttctagtgtatttgttttattctggcagagagtacaagttgtataaattgtacgagttcagtaaacatgaagcacatctatttttattttgtctactaagatggtacatctaaagtgcttagcaactataagtagaccatggtaaaagtgtccaataactggtagtgattattatcatattgtcattctttcgttgagcaaaatgttaattataagttattttattatagaatgcattcattgttataaattatatttgttgaataaaagcataatctgattttttttcccttggcagcaacttgagttggtggaaccaagtggct

SEQ ID NO: 285910 - DNA, 598 bp, Homo sapiens
gagaatctgagtttcggcaagcagccaggtctggaaactctgtgagtgtgtgggcttttctccgacgtcgagcgtggtcctagcgtaaacagatgcattcgcctctccggtttcaatctttttttacgtttgcgctttcctcaaggccggtgggtcaggagtggagccttagtcattctaacgctggaggtgtcagtaggaccaacagagtctggtgccgacacggcttactgttgcgcgctcttctaggcctcaacttcctctcaactgtgtggtcagttcagggccgggaatccaatcttttccgagctccatattttatccacttggtggcgtccagtcccaagtccggcagttgaattctgccctaaagatgggctttatttctatctttttttaggtaacaggacattcagttagtaatgatggttgcaggttgaatagtctcgccctagatctcacctaacttgcaggcaagtgacaactagttcataactgaacctattcatctgtttattcattcagtaaattacttattgagcgtttaagcctcaggccttgccaaagtttacagtccgttgtgtctgccgttatttag

SEQ ID NO: 285911 - DNA, 881 bp, Homo sapiens
gacgtcattgagctgcgacccttgttcaacgccgttggcgaagccagctgctggaggtgccgagaatctgagtttcggcaagcagccaggtctggaaactaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattacta

SEQ ID NO: 285912 - DNA, 1676 bp, Homo sapiens
gacgtcattgagctgcgacccttgttcaacgccgttggcgaagccagctgctggaggtgccgagaatctgagtttcggcaagcagccaggtctggaaactaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattactataaaaatggatttgaagccaatcattttattttcccttgtatcaaaagaaaagagttccttgtatcaaaagaaaagagttgaactgaaaatttcagtatatacacaattataatagctaggtgattatttcattagtgttcatacattagagtaatggtttattgcatatttgagaacaagactgtgttttatcaatatatatcatctttaataggtcaaaattactattttttctacccagaggaaggttattcttttaatactggatcttttaaaaaacagtgtcaaataagcttagtgttaggttgtctgatgagaaccaatctaatatggggagtataattaattgtctcatattcaccttcacggaatacttacagccctagggttgtctgtatcctaatgatattatgtaaagattgcctgtataatctagcagtacttatggaagagttctagcagtacttatggaagagttattttcaaatttgtgtctgacattgtagcattccctgggcagtcatatatcccataaaatcgtaaaagtatgtgaaattttttatatatattaaaagattttaaagaaatacatggaaatgtggttttttccatggtttaaaatgagtagatttgattttgtatgctgttttctctagatgtattactttttttcgggggatggttatttagccacagaatttacctagattcactcttgtttggaaaagattgctctctgtggttcatgcattgctgggtacactaaagtattaaatagtgaatattatttaaaa

SEQ ID NO: 285913 - DNA, 751 bp, Homo sapiens
  misc_feature (747)..(747): n is a, c, g, or t
gacgtcattgagctgcgacccttgttcaacgccgttggcgaagccagctgctggaggtgccgagaatctgagtttcggcaagcagccaggtctggaaactaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaaacagggccacattttttctncccc

SEQ ID NO: 285914 - DNA, 919 bp, Homo sapiens
gacgtcattgagctgcgacccttgttcaacgccgttggcgaagccagctgctggaggtgccgagaatctgagtttcggcaagcagccaggtctggaaactaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcgggctttggtatcaggatgatgctggcctcatcaaatgagcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattacta

SEQ ID NO: 285915 - DNA, 1383 bp, Homo sapiens
gacgtcattgagctgcgacccttgttcaacgccgttggcgaagccagctgctggaggtgccgagaatctgagtttcggcaagcagccaggtctggaaactctgtgagtgtgtgggcttttctccgacgtcgagcgtggtcctagcgtaaacagatgcattcgcctctccggtttcaatctttttttacgtttgcgctttcctcaaggccggtgggtcaggagtggagccttagtcattctaacgctggaggtgtcagtaggaccaacagagtctggtgccgacacggcttactgttgcgcgctcttctaggcctcaacttcctctcaactgtgtggtcagttcagggccgggaatccaatcttttccgagctccatattttatccacttggtggcgtccagtcccaagtccggcagttgaattctgccctaaagatgggctttatttctatctttttttaggtaacaggacattcagttagtaatgatggttgcaggttgaatagtctcgccctagatctcacctaacttgcagtaagtatcaagtgcttgtgtgccgattaaagaacaacttcggatacaatgggaggtgtcaaggaaacgaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattacta

SEQ ID NO: 285916 - DNA, 1022 bp, Homo sapiens
gacgtcattgagctgcgacccttgttcaacgccgttggcgaagccagctgctggaggtgccgagaatctgagtttcggcaagcagccaggtctggaaactgtaacaggacattcagttagtaatgatggttgcaggttgaatagtctcgccctagatctcacctaacttgcagtaagtatcaagtgcttgtgtgccgattaaagaacaacttcggatacaatgggaggtgtcaaggaaacgaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattacta

SEQ ID NO: 285917 - DNA, 992 bp, Homo sapiens
gacgtcattgagctgcgacccttgttcaacgccgttggcgaagccagctgctggaggtgccgagaatctgagtttcggcaagcagccaggtctggaaactgtaacaggacattcagttagtaatgatggttgcaggttgaatagtctcgccctagatctcacctaacttgcagaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcgggctttggtatcaggatgatgctggcctcatcaaatgagcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattacta

SEQ ID NO: 285918 - DNA, 1555 bp, Homo sapiens
gacgtcattgagctgcgacccttgttcaacgccgttggcgaagccagctgctggaggtgccgagaatctgagtttcggcaagcagccaggtctggaaactaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattactataaaaatggatttgaagccaatcattttattttcccttgtatcaaaagaaaagagttccttgtatcaaaagaaaagagttgaactgaaaatttcagtatatacacaattataatagctaggtgattatttcattagtgttcatacattagagtaatggtttattgcatatttgagaacaagactgtgttttatcaatatatatcatctttaataggtcaaaattactattttttctacccagaggaaggttattcttttaatactggatcttttaaaaaacagtgtcaaataagcttagtgttaggttgtctgatgagaaccaatctaatatggggagtataattaattgtctcatattcaccttcacggaatacttacagccctagggttgtctgtatcctaatgatattatgtaaagattgcctgtataatctagcagtacttatggaagagttctagcagtacttatggaagagttattttcaaatttgtgtctgacattgtagcattccctgggcagtcatatatcccataaaatcgtaaaagtatgtgaaattttttatatatattaaaagattttaaagaaatacatggaaatgtggttttttccatggtttaaaatgagtagatttgattttgtatgctgttttctctagatgtattactttttttcgggggatggttatttagccacagaatttacctagattcactcttgtttggaaaagattgctctctgtggttcatgcattgctgggtacactaaagtattaaatagtgaatattatttaaaa

SEQ ID NO: 285919 - DNA, 975 bp, Homo sapiens
gacgtcattgagctgcgacccttgttcaacgccgttggcgaagccagctgctggaggtgccgagaatctgagtttcggcaagcagccaggtctggaaactctgtgagtgtgtgggcttttctccgacgtcgagcgtggtcctagcgtaaacagatgcattcgcctctccggtttcaatctttttttacgtttgcgctttcctcaaggccggtgggtcaggagtggagccttagtcattctaacgctggaggtgtcagtaggaccaacagagtctggtgccgacacggcttactgttgcgcgctcttctaggcctcaacttcctctcaactgtgtggtcagttcagggccgggaatccaatcttttccgagctccatattttatccacttggtggcgtccagtcccaagtccggcagttgaattctgccctaaagatgggctttatttctatctttttttaggtaacaggacattcagttagtaatgatggttgcaggttgaatagtctcgccctagatctcacctaacttgcagaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcctcatgttttacatgtgaatgaagaatcaatgaatcttcaagtctcaggataaaggaatgagaatattgaagcagaaactgcaaataaaagacaatgcata

SEQ ID NO: 285920 - DNA, 292 bp, Homo sapiens
cagtgttgttctaagctgttttattgacccaactgctgagatgtagtctccaggtcaggataaggtgaccttatgatgggccataactagaggaaggcagaatgggaaaaggaacaaggtcaacatattccccgacacaaaaccccctaggtgatccgtcaatgtctgggtgagtgacatctactgtctgagcagttgtgggggacagagtgggctgggcccaggtgtcactcattagctttgatgtggcctctaatcatctcccaggcctacctgacacattgttaaatgc

SEQ ID NO: 285921 - DNA, 539 bp, Homo sapiens
gagccgcttcatcctctactcggtgtaactatctctgagattccacatcctttgagattaaaaacactttacatcttctgggtctgttgacgggtccttccaccaatcacatcgctgtgcttctgtgacaactgaacacaactggaagtgaaaaacaactcctcattcaaaggggtttaacaacttgaacagatctcttcagaaccgggaaaacatctccttttgttgacatcacatgaaggttgaagtccgctgtcaggaccatgtttaaggatctcaattgccatgtggataagtcaacgacgggcagccaacaggaacaagtatccattagattatcatggagctgaaaagttcctaccacctagtgacatcatgccatcgtaacatcacaatgcaaagcatcacccatgtgtttgtggtggtaatggtgtaaacaaactcaccttgctgccagctgtgtaaaagtctagcatgtacaattatgtacagtatataatacttgaaaatgataataaatgactatgttactatgttta

SEQ ID NO: 285922 - DNA, 411 bp, Homo sapiens
cctccattccaaactctcctgtataaagtctgcatttgtatgggcaaaataaatgaaatgggacacaggaaatatgtacttcgctgttttaacaccaatggagactgctagtttgcctaagagactaccgaaaacacaattctattatagtcacaaaagaaaatgaagttagaaaaactgaaagttacctataaaagtctgttgggcctgtgaatttccccctaccctcggggaacatgaatgaggataattagatgcattagcacccattttcttcagtcactcaggcattccgtctgcgggttcttcagagtataatcccagaggcctttatgaaccttcaaccctggatccagcagcctcttttcatccatttcttgatatgaaataaaaataatttaattcaaaaaa

SEQ ID NO: 285923 - DNA, 498 bp, Homo sapiens
ggatgactctgctggatctagagctaaatagaaacttctttgccatagaaacttctctgttgaaggactgcgtccccattcaaagaggtcagatttgtgggcaggcaagagctcaggaatgaagaaccaaaaaggaggctctcaacccctctccaaggccagacgctctctgtactcccattaacttcacaaccaagtgcagacgctcgaccaactcttcagccagtgcatgcagggctctggaggtgatgccagcaggatctggaggatctcgctctgtaacccaggctctggaatgcagtggcacaaccacggctcactgcagtctcaacctcctgggctcaactgatccccccacttcagcctcctgagtagctgggactacagaggacactggaggtgaagaaggaagctcttgactctcctaaagctgatcccaaagtgaaggctttgaaggccaagaaggcagtgctgaaaggcatccacacagccaccaag

SEQ ID NO: 285924 - DNA, 407 bp, Homo sapiens
tgggtcactgtaggtcctgcatgaacttgtccaccaactgtgttttgctgtttgggttgtaaattaaccgtgaatacaagtaaccaagaaaatcctctccacagaccaactcttcagccagtgcatgcagggctctggaggtgatgccagcaggatctggaggtgaggcactgggtggtttctcagacacccggagatggcttcagcctgggccgccccagctgcctagtgcactggtgtccctccaacacaggctactcccccaacacccatgtgccaccaagtttctcaactgcacacgccagatgcgcgttttacgagaatcaaatgagtatttatactgtatatgtgtgtgtgtatatatatatatataaattaatctgcacgtatataaacactaaaaggag

SEQ ID NO: 285925 - DNA, 462 bp, Homo sapiens
agtctgttgtacctggaataaaaaagcagaggaagtgacaccctcacttgaaatggtcacttcccttcaatgtgctgcagagaacaggactgatgtggggaatgctgctgctgctgcttgtcaaacatctacggctgatggccacacattacttcttcaaatgaccttggacctcagagccttcactataagtaggtacatggtacctctcccagggatgttgtgggacccatgaagagtccgctgtctgtgatgtgcaaggtgctctgagtcaggtgcagcttgtactgctataggagcctaagaatctgcctcacctacactccctctgggcaattaggtatgctgaaaatgcccaacagacattcaggactacattggtatctgtttaaggaaaatcctcagctgctcacacagtaatgaaagagacaagctagaaaattactacttgataagactctg

SEQ ID NO: 285926 - DNA, 2908 bp, Homo sapiens
ggctggaagcaacagatggggactgcagaggaggtggtggtattgggatagtgctgcagccaagaacttaacgactgaaagtaactgggatatcttcataattatctgaaggtcacagtgggagaacaaaattaaaagaactgagaagacttacaagagaacctcctaagagtcacccaaacaatcggctgagaatgagaagaggttcaagtgattcttgtgcctcaggctcccaagtagctgggactacagtagctgggccagcacacccagaaagcctcacattgtgcagtggagaagctgagagaagaggaaaagaggagtggccagactcccaccactacccaggaccaactcctgctcctgaatcttctgatgggccccacaaggtgacagtgctggctacaatgctatccagccggtggtggccaagttcctgggggatcctagggctgggcccccgaagccctcctcggggatcccagctctgtgccctctatgcctttacttatactggggcagatggccagcaggtgtctctggctgaaggggataggttcctactgcttcgaaagaccaactccgactggtggttggcaagacgcctagaagctccctccacctctcgacccatcttcgtcccagcagcctatatgatagaggaatccatcccttcccagagtccaactaccgtcatccccggccaattgctctggactcctgggccgaagttgtttcatggttccctggaggagttgtctcaggccctcccaagcagggctcaggctagctcggagcagcctcctccacttccccgcaaaatgtgtaggagcgtcagcactgacaatctgagccccagccttctgaagcctttccaggaaggaccaagcggaagatccctctcccaggaagacttgccgtcagaagccagtgccagcacagcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctccgcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggttagatgggtggaggcccggagggaggctccgaccggccgggaccaagggagtggggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgtggtcaccggagccctgaagctttttctccgggagctgccccagcctctggtgccaccactgctgctgccccatttccgtgctgcccttgcactctccgaatcagagcagtgcctctctcagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggta

SEQ ID NO: 285927 - DNA, 2583 bp, Homo sapiens
ctccctgtttctgtcttgaacctgattctttcttcttatctccttcctgtgtccacctcaagactcccaccactacccaggaccaactcctgctcctgaatcttctgatgggccccacaaggtgacagtgctggctacaatgctatccagccggtggtggccaagttcctgggggatcctagggctgggcccccgaagccctcctcggggatcccagctctgtgccctctatgcctttacttatactggggcagatggccagcaggtgtctctggctgaaggggataggttcctactgcttcgaaagaccaactccgactggtggttggcaagacgcctagaagctccctccacctctcgacccatcttcgtcccagcagcctatatgatagaggaatccatcccttcccagagtccaactaccgtcatccccggccaattgctctggactcctgggccgaagttgtttcatggttccctggaggagttgtctcaggccctcccaagcagggctcaggctagctcggagcagcctcctccacttccccgcaaaatgtgtaggagcgtcagcactgacaatctgagccccagccttctgaagcctttccaggaaggaccaagcggaagatccctctcccaggaagacttgccgtcagaagccagtgccagcacagcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctccgcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgtggtcaccggagccctgaagctttttctccgggagctgccccagcctctggtgccaccactgctgctgccccatttccgtgctgcccttgcactctccgaatcagagcagtgcctctctcagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggta

SEQ ID NO: 285928 - DNA, 847 bp, Homo sapiens
ggaaaggggctcctcttcccttctgtagacccttctctgtcttcttttaccttgcaggatgtgagggtggggcacccccttcaacattccccccaccccacaaaaagcctgttcccctttcctgtggccctgaggtgggggtggggtgggggaggcgggaagttggcaacaggaagtgaggagaagagcaaagaaaactgtgagagagagaatttttaaaaagcagctggggcctgaggtttctcccccagtaccctgggtcacctcagcccagagctggcggcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgtgaacctcccatttctttgtgaaggccaagatcctccctgccccccctccccccttttcctgctccacataaacatcttcctctttctgaatatcctcctacccagccctcccccagcaactttaagggacttca

SEQ ID NO: 285929 - DNA, 2057 bp, Homo sapiens
ggaaaggggctcctcttcccttctgtagacccttctctgtcttcttttaccttgcaggatgtgagggtggggcacccccttcaacattccccccaccccacaaaaagcctgttcccctttcctgtggccctgaggtgggggtggggtgggggaggcgggaagttggcaacaggaagtgaggagaagagcaaagaaaactgtgagagagagaatttttaaaaagcagctggggcctgaggtttctcccccagtaccctgggtcacctcagcccagagctggcggcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctccgcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagcactctccgaatcagagcagtgcctctctcagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggta

SEQ ID NO: 285930 - DNA, 2264 bp, Homo sapiens
ggaaaggggctcctcttcccttctgtagacccttctctgtcttcttttaccttgcaggatgtgagggtggggcacccccttcaacattccccccaccccacaaaaagcctgttcccctttcctgtggccctgaggtgggggtggggtgggggaggcgggaagttggcaacaggaagtgaggagaagagcaaagaaaactgtgagagagagaatttttaaaaagcagctggggcctgaggtttctcccccagtaccctgggtcacctcagcccagagctggcggcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctccgcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgtggtcaccggagccctgaagctttttctccgggagctgccccagcctctggtgccaccactgctgctgccccatttccgtgctgcccttgcactctccgaatcagagcagtgcctctctcagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggtaaaaaaaaaacatcacaccaccaacaacaaactcaaataaacacctcgacactattcaccagcaaaaatactg

SEQ ID NO: 285931 - DNA, 2086 bp, Homo sapiens
ggaaaggggctcctcttcccttctgtagacccttctctgtcttcttttaccttgcaggatgtgagggtggggcacccccttcaacattccccccaccccacaaaaagcctgttcccctttcctgtggccctgaggtgggggtggggtgggggaggcgggaagttggcaacaggaagtgaggagaagagcaaagaaaactgtgagagagagaatttttaaaaagcagctggggcctgaggtttctcccccagtaccctgggtcacctcagcccagagctggcggcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctccgcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgtggtcaccggagccctgaagctttttctccgggagctgccccagcctctggtgccaccactgctgctgccccatttccgtgctgcccttgggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggta

SEQ ID NO: 285932 - DNA, 2106 bp, Homo sapiens
ggaaaggggctcctcttcccttctgtagacccttctctgtcttcttttaccttgcaggatgtgagggtggggcacccccttcaacattccccccaccccacaaaaagcctgttcccctttcctgtggccctgaggtgggggtggggtgggggaggcgggaagttggcaacaggaagtgaggagaagagcaaagaaaactgtgagagagagaatttttaaaaagcagctggggcctgaggtttctcccccagtaccctgggtcacctcagcccagagctggcggcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctccgcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgtggtcaccggagccctgaagctttttctccgggagctgccccagcctctggtgccaccactgctgctgccccatttccgtgctgcccttgggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggtattttttctgatgcagttcct

SEQ ID NO: 285933 - DNA, 1632 bp, Homo sapiens
agccaagtataagaagggtgtggagagtgggtagaggtggcatctggatgtagctttatttcctcctcccctaacccagaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctccgcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagcactctccgaatcagagcagtgcctctctcagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggta

SEQ ID NO: 285934 - DNA, 1517 bp, Homo sapiens
ggaaaggggctcctcttcccttctgtagacccttctctgtcttcttttaccttgcaggatgtgagggtggggcacccccttcaacattccccccaccccacaaaaagcctgttcccctttcctgtggccctgaggtgggggtggggtgggggaggcgggaagttggcaacaggaagtgaggagaagagcaaagaaaactgtgagagagagaatttttaaaaagcagctggggcctgaggtttctcccccagtaccctgggtcacctcagcccagagctggcggcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagcactctccgaatcagagcagtgcctctctcagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggta

SEQ ID NO: 285935 - DNA, 1506 bp, Homo sapiens
ggctggaagcaacagatggggactgcagaggaggtggtggtattgggatagtgctgcagccaagaacttaacgactgaaagtaactgggatatcttcataattatctgaaggtcacagtgggagaacaaaattaaaagaactgagaagacttacaagagaacctcctaagagtcacccaaacaatcggctgagaatgagaagaggttcaagtgattcttgtgcctcaggctcccaagtagctgggactacagtagctgggccagcacacccagaaagcctcacattgtgcagtggagaagctgagagaagaggaaaagaggagtggccagactcccaccactacccaggaccaactcctgctcctgaatcttctgatgggccccacaaggtgacagtgctggctacaatgctatccagccggtggtggccaagttcctgggggatcctagggctgggcccccgaagccctcctcggggatcccagctctgtgccctctatgcctttacttatactggggcagatggccagcaggtgtctctggctgaaggggataggttcctactgcttcgaaagaccaactccgactggtggttggcaagacgcctagaagctccctccacctctcgacccatcttcgtcccagcagcctatatgatagaggaatccatcccttcccagagtccaactaccgtcatccccggccaattgctctggactcctgggccgaagttgtttcatggttccctggaggagttgtctcaggccctcccaagcagggctcaggctagctcggagcagcctcctccacttccccgcaaaatgtgtaggagcgtcagcactgacaatctgagccccagccttctgaagcctttccaggaaggaccaagcggaagatccctctcccaggaagacttgccgtcagaagccagtgccagcacagcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgtgaacctcccatttctttgtgaaggccaagatcctccctgccccccctccccccttttcctgctccacataaacatcttcctctttctgaatatcctcctacccagccctcccccagcaactttaagggacttca

SEQ ID NO: 285936 - DNA, 527 bp, Homo sapiens
ggtgactctgaggatcccaggctataccaccagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggta

SEQ ID NO: 285937 - DNA, 765 bp, Homo sapiens
cccctccctcaagcttctgctaaccatcttctcttgtttttctttgatcagcctacctcttgcccccgccatggcatcctcatcccactgcctgtcctcctagtcctaaggcttctaggtctcatgccattttccacatcctccctctgcccttcttgtcttccctgtgagttcccaagatgagggacccagttacaacaacacctctgatcacctgccacccaccctccccttttctgtttccagggccgaagttgtttcatggttccctggaggagttgtctcaggccctcccaagcagggctcaggctagctcggagcagcctcctccacttccccgcaaaatgtgtaggagcgtcagcactgacaatctgagccccagccttctgaagcctttccaggaaggaccaagcggaagatccctctcccaggaagacttgccgtcagaagccagtgccagcacagtgagtcacagctcttctgagctgggccctgttctaggcacaggacagacagcacctctgtcttcaggggactcccctggggatgacaaacacaaaaacaaataaataagataacgcttggtactactgataagtctaaaggcaagttaatgtggtggagagtggctgaggtggtgcggggagacatctgtgaggtcacggcattcagttgactctgagcaaggaggagaaagaggcagccgagaggcaaactgggtaggaggtgagaagggacagtaggtaccaaaggccctgaggggac

SEQ ID NO: 285938 - DNA, 439 bp, Homo sapiens
ttgtgggccagtggttgtactaagaatgtcttgcctgagaaccatgggcggtcctacatgaggaagctggcagaatagagaggccgtcaggctggtagtgtgtgtcttagctcctgatctctcctcattcatgttgcagagcgtgcggtcacctccgatgggaggtatgtgttcccagaacagccaggacaaggtacttacatggaagacccttcagatccctaaaacttccacatatcctctttgcttcccgtggaaacccccatgtactattcctgggagggttgtcctcatccccaccttagctaccttgccccactgcagaccctctaggcattcctatagtctgctttgactggatttctccagaacttctaatctctcagtctctaaatctttctggcccttcatgagcccctatacctccttctccctccag

SEQ ID NO: 285939 - DNA, 554 bp, Homo sapiens
tgctgagaagagctcctgtgagtgacgctggcactggcttcccgcctcactctacttccccagaccaggtgttcggctgccagttggaatcactctgccagcgggaaggagacacggtgcccagctttttgcggctctgcattgctgctgtggataaaagaggtcattttctcagagaccccaggatcctcttccaacaggctaaggcctagaattttctgcctcccccattctacctagtcttcctactgccctttttctctccacccttatatccctcaccacacacactttcaagcagcagtccttatctactccttcctcatctcccaggtctagatgtggatggcatttatcgggtgagcgggaacttggcagtggtccagaagcttcgctttctggtggacagaggtgagaaggcttgtgggccagtggttgtactaagaatgtcttgcctgagaaccatgggcggtcctacatgaggaagctggcagaatagagaggccgtcaggctggtagtgtgtgtcttagctcctgatctctcctcattcatg

SEQ ID NO: 285940 - DNA, 324 bp, Homo sapiens
ggtggaggcccggagggaggctccgaccggccgggaccaagggagtggggtaggaacgataggagtcaggagcagttgggggcagggtgggctcagtggagagcccttgcctgggccgggatgtgggaccccggcagtgggtcagagtccagctagggatacagatttctctcctctctcaccttcgacacggcccgccccgggtctaggatcgggagaaccccctggagctgcgtctgtcgggctctggacccgcggagctgagcgccggggaggacgaagaagaggagtcggagctggtgtccaagccgctgctgcgcctca

SEQ ID NO: 285941 - DNA, 127 bp, Homo sapiens
cagttgtgcctgcccctcactgccctctccgcacacagattccctgtccaccaggccagggatgtgggcgggggctggggagcggccagagtcggaatgaaagggcctttttcttccacagctggga

SEQ ID NO: 285942 - DNA, 129 bp, Homo sapiens
cagacttggtatagtgggagagcctgactgaggtggctctagccagtctaattgccgttcctttagctagtggcatcttgattcctgctgtgtcttaactgaccattgtcttaaattctagagtggatc

SEQ ID NO: 285943 - DNA, 346 bp, Homo sapiens
gattggaggcctttgtttgccgctcaactccaggaaaccacccgcgctcggcggccgccagcagtcctggaaggtgggaatgatctggagaccaggagtaagaagacctgagtttagatccccagcctggattcagttctgagtgcctcagttttcccttccacaaaatgaggaggggcaactgaagacggaggtgcccaaggtcagaaggaagcaccacacagagggcacaggcaggatggccgatgctgacaggaaccagcggtgactctggggcccctggcagcagctctgtctcctgaagatgaagtggcccaggtgaagcccaggccagccccaatggcca

SEQ ID NO: 285944 - DNA, 577 bp, Homo sapiens
gattggaggcctttgtttgccgctcaactccaggaaaccacccgcgctcggcggccgccagcaggtgagactcggggaggggctcgcggggcgtccggggtggtccctgtccctcgttgggactcagtttctccgtcgggagaatggggagggagagtggacagcgccagtgggctccgttccactgggacggcgctgctttcggtcttttccacgtggaaaccccacgcgcacggggaaggagacgcatcaccgctccgggaatgggagggagccctggacgggcggtatgggccccagtccaaaccgtgccggccgcggggttcctcagtctccaccctccggcctcagtctccacctctgcacaatgggggcgttggctttttctctttccagctggggctggtggcagggaggggaggggtcccgggggagctcgggggtgggccttggcggggcctcgggctgtgtttgggctggaggcgtggcccgggttgctgtggttactggggaggtgaggctttctgtctgggatttgtgtgagattcgttcacccagcaacaatccgcgcagcctg

SEQ ID NO: 285945 - DNA, 654 bp, Homo sapiens
ctttggtctcggtgcccagggcccaggccgtgtggttgggaagactggaccctgagcagcttcttgggccctggtacgtgcttgcggtggcctcccgggaaaagggctttgccatggagaaggacatgaagaacgtcgtgggggtggtggtgaccctcactccagaaaacaacctgcggacgctgtcctctcagcacgggctgggagggtgtgaccagagtgtcatggacctgataaagcgaaactccggatgggtgtttgagaatccctcaataggcgtgctggagctctgggtgctggccaccaacttcagagactatgccatcatcttcactcagctggagttcggggacgagcccttcaacaccgtggagctgtacagtctgacggagacagccagccaggaggccatggggctcttcaccaagtggagcaggagcctgggcttcctgtcacagtagcaggcccagctgcagaaggacctcacctgtgctcacaagatccttctggctggcggctccagagaggtttaaacactggccttggcggctgagggaggagggtgaagatgaggcaggggctgctggtgctggcgctggtgctggtgctggtgctagtgctggctgcagggtcccaggtgcaggagtggtaccc

SEQ ID NO: 285946 - DNA, 385 bp, Homo sapiens
ggcggggggttttgtttcctagcaataggcgtgctggagctctgggtgctggccaccaacttcagagactatgccatcatcttcactcagctggagttcggggacgagcccttcaacaccgtggagctgtacagtctgacggagacagccagccaggaggccatggggctcttcaccaagtggagcaggagcctgggcttcctgtcacagtagcaggcccagctgcagaaggacctcacctgtgctcacaagatccttctgtgagtgctgcgtccccagtagggatggcgcccacagggtcctgtgacctcggccagtgtccacccacctcgctcagcggctcccggggcccagcaccagctcagaataaagcgattccacagca

SEQ ID NO: 285947 - DNA, 1013 bp, Homo sapiens
ctctggcctcactgctggctggcctggcctggactcctgagctccgtctcctctcaccgggccccggggtcttgaccctgagtgggtgacaggccccttcttttccaggctgggagggtgtgaccagagtgtcatggacctgataaagcgaaactccggatgggtgtttgagaatccctcaataggcgtgctggagctctgggtgctggccaccaacttcagagactatgccatcatcttcactcagctggagttcggggacgagcccttcaacaccgtggagctgtacagtctgacggagacagccagccaggaggccatggggctcttcaccaagtggagcaggagcctgggcttcctgtcacagtagcaggcccagctgcagaaggaccgtgagtgtccaccggagcagcctcgggggaggcttggggcaagttctggagcccacagggcgtgatggggtgacagagaccctggggttgattctggcttctgcctgactcagtcgccctgaaggagtcaggcaggctgagggggtcttcacctgcccctgcccaaagtcaggcctgggggtcttgtccccacggcaggcgagtcttgtgggtggggccctggggtgctggggggctcagtcctttttcacagccagtcttgcctccccttctagtcacctgtgctcacaagatccttctggtaagccgccatcctgagcctcaccctgggctctcttgggggaagggggtgggggaggccaccctacgcacagtgggtgggaggaccctctgcccaagcccacggggttcatggctccactgtctctaaggcagctgagggtgtggaggagcctccatggtgggctgggccccctcacactcctcttggttttcagtgagtgctgcgtccccagtagggatggcgcccacagggtcctgtgacctcggccagtgtccacccacctcgctcagcggctcccggggcccagcaccagctcagaataaagcgattccacagca

SEQ ID NO: 285948 - DNA, 275 bp, Homo sapiens
ctttggtctcggtgcccagggcccaggccgtgtggttgggaagactggaccctgagcagcttcttgggccctggtacgtgcttgcggtggcctcccgggaaaagggctttgccatggagaaggacatgaagaacgtcgtgggggtggtggtgaccctcactccagaaaacaacctgcggacgctgtcctctcagcacgggtgagtgggcgggtcctgccaggccttcccgcaggcaggactgtggctcagccacatcatgtactttgcacatctg

SEQ ID NO: 285949 - DNA, 908 bp, Homo sapiens
ggagacactcactggggcaatctgaggtaatccaacagactgtggcggagggaccggaagcgccaggcagggacccggggtagatgctaaatccaaactgaaacgtacagggctggatgattgaagcaccagcgggaactagtcggacctccgagctctttaaactgtcctcagctcggctggttctccacgagctccgggcagacggcggggggtgggtcggcgtttaagtcaaaggccttggggctccgagtcccttcctctccccgtcctgtgaaggcacgacccagttcagctgtctgtaaagtggagccattagtccctgcctcgtagtgggaaaactgggaggcggaacgaggaggccgccggtcccaacccggcccaggagcatctttctccgcagaccgtttcctggcgagatcctgcgcagccgaggctgtgttagcgccaaggacttccagcagctgttagcagagtggcctcaggaggatgggaggccccacctggtaacaaccctgtgccaccccagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcggggcccagcaagaaagaacagccccttctggccttcctgctgggggacagaggctcccagagccacttctgagttggggtacagacttcggtggctcatcagatgaaaggaggtgcagagagagcctgaagttggctctgtgatcccgacttggctgtcactggcc

SEQ ID NO: 285950 - DNA, 424 bp, Homo sapiens
gtaccgggcccccccttggagggaacgggccttatagggcggatcccttgcccaagcttttacagcaggagcagatgtgatcccagccacagcttccaggcccctgggctcctcacaccttaccatataccccgcaggctgctgccagggctgctgccccgctccctcctcctccttcccctggagtcagtggtgggaagcttcccaggagagtcctcagcaacctctggaacacaggacttggccatgactgtctcctgtccctgtgtgggcccagatggttgaggtacatctaggggttctcatcccagctaggctcaggttggggcagcctgaaacaggatgggtccccttctagaagtccctttcagctaacagtctggaacttgcagttgacccagatagattcaggagtgtaggctag

SEQ ID NO: 285951 - DNA, 1821 bp, Homo sapiens
tcaggctagtaccgatctcgggaatataggattctacggcaagctgcgtagcggctgtgggtgcttcactatggcgacggtgggggctccgcggcacttctgccgctgcgcctgcttctgcaccgataacttgtacgtggcgcgctatgggctgcacgtgcgcttccgaggcgagcagcagctgcgccgggactacggcccgatcctgcgcagccgaggctgtgttagcgccaaggacttccagcagctgttagcagagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcggaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaagggaagcctccagagagcacagatgtgaaccctcagcagcaggcatcaccccccagtggactcgggtgggccaccagtagcatcttctagatggcagaggggtgaatggcagggccaggaaccaggctgcccgggttcccattctgcttctgccacttccagctgtgtggctttaggtgagccttcaccttttggtgccttcgtttcctcatttagcacctacctcctagagctgttttgggagtcaaatgcgctgacgtatataaagtgctttgcaagatc

SEQ ID NO: 285952 - DNA, 2001 bp, Homo sapiens
aaggctaggtagaggcctgggtggtgaattcgccgagccggggtagatgctaaatccaaactgaaacgtacagggctggatgattgaagcaccagcgggaactagtcggacctccgagctctttaaactgtcctcagctcggctggttctccacgagctccgggcagacggcggggggtgggtcggcgtttaagtcaaaggccttggggctccgagtcccttcctctccccgtcctgtgaaggcacgacccagttcagctgtctgtaaagtggagccattagtccctgcctcgtagtgggaaaactgggaggcggaacgaggaggccgccggtcccaacccggcccaggagcatctttctccgcagaccgtttcctggcgagatcctgcgcagccgaggctgtgttagcgccaaggacttccagcagctgttagcagagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcggaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaagggaagcctccagagagcacagatgtgaaccctcagcagcaggcatcaccccccagtggactcgggtgggccaccagtagcatcttctagatggcagaggggtgaatggcagggccaggaaccaggctgcccgggttcccattctgcttctgccacttccagctgtgtggctttaggtgagccttcaccttttggtgccttcgtttcctcatttagcacctacctcctagagctgttttgggagtcaaatgcgctgacgtatataaagtgctttgcaagatc

SEQ ID NO: 285953 - DNA, 2002 bp, Homo sapiens
ggagacactcactggggcaatctgaggtaatccaacagactgtggcggagggaccggaagcgccaggcagggacccggggtagatgctaaatccaaactgaaacgtacagggctggatgattgaagcaccagcgggaactagtcggacctccgagctctttaaactgtcctcagctcggctggttctccacgagctccgggcagacggcggggggtgggtcggcgtttaagtcaaaggccttggggctccgagtcccttcctctccccgtcctgtgaaggcacgacccagttcagctgtctgtaaagtggagccattagtccctgcctcgtagtgggaaaactgggaggcggaacgaggaggccgccggtcccaacccggcccaggagcatctttctccgcagaccgtttcctggcgagatcctgcgcagccgaggctgtgttagcgccaaggacttccagcagctgttagcagagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcggcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaagggaagcctccagagagcacagatgtgaaccctcagcagcaggcatcaccccccagtggactcgggtgggccaccagtagcatcttctagatggcagaggggtgaatggcagggccaggaaccaggctgcccgggttcccattctgcttctgccacttccagctgtgtggctttaggtgagccttcaccttttggtgccttcgtttcctcatttagcacctacctcctagagctgttttgggagtcaaatgcgctgacgtatataaagtgctttgcaagatc

SEQ ID NO: 285954 - DNA, 2353 bp, Homo sapiens
ggagacactcactggggcaatctgaggtaatccaacagactgtggcggagggaccggaagcgccaggcagggacccggggtagatgctaaatccaaactgaaacgtacagggctggatgattgaagcaccagcgggaactagtcggacctccgagctctttaaactgtcctcagctcggctggttctccacgagctccgggcagacggcggggggtgggtcggcgtttaagtcaaaggccttggggctccgagtcccttcctctccccgtcctgtgaaggcacgacccagttcagctgtctgtaaagtggagccattagtccctgcctcgtagtgggaaaactgggaggcggaacgaggaggccgccggtcccaacccggcccaggagcatctttctccgcagaccgtttcctggcgagatcctgcgcagccgaggctgtgttagcgccaaggacttccagcagctgttagcagagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcgggggtgaggtcctggccctgagacctggcaggaccagggaatggcagcctgggaaacctgggtgtgggatgctggggtccctccagccaccatctctgcctccaaaaaccaaaccagcaggagctggaagggtcagtgggaccaacctgccaggagcaggacatccgcattcattcattcaatacctgccatgagcctgccctgaaaagcaaaggcctcatctccatggcacaggtgatgaaacaggaagactgaagcccaggcctggccggcccacggccacattcaggccaacagaccatccctccttccacagaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaagggaagcctccagagagcacagatgtgaaccctcagcagcaggcatcaccccccagtggactcgggtgggccaccagtagcatcttctagatggcagaggggtgaatggcagggccaggaaccaggctgcccgggttcccattctgcttctgccacttccagctgtgtggctttaggtgagccttcaccttttggtgccttcgtttcctcatttagcacctacctcctagagctgttttgggagtcaaatgcgctgacgtatataaagtgctttgcaagatc

SEQ ID NO: 285955 - DNA, 2120 bp, Homo sapiens
ggagacactcactggggcaatctgaggtaatccaacagactgtggcggagggaccggaagcgccaggcagggacccggggtagatgctaaatccaaactgaaacgtacagggctggatgattgaagcaccagcgggaactagtcggacctccgagctctttaaactgtcctcagctcggctggttctccacgagctccgggcagacggcggggggtgggtcggcgtttaagtcaaaggccttggggctccgagtcccttcctctccccgtcctgtgaaggcacgacccagttcagctgtctgtaaagtggagccattagtccctgcctcgtagtgggaaaactgggaggcggaacgaggaggccgccggtcccaacccggcccaggagcatctttctccgcagaccgtttcctggcgagatcctgcgcagccgaggctgtgttagcgccaaggacttccagcagctgttagcagagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcgggtgatgaaacaggaagactgaagcccaggcctggccggcccacggccacattcaggccaacagaccatccctccttccacagaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaagggaagcctccagagagcacagatgtgaaccctcagcagcaggcatcaccccccagtggactcgggtgggccaccagtagcatcttctagatggcagaggggtgaatggcagggccaggaaccaggctgcccgggttcccattctgcttctgccacttccagctgtgtggctttaggtgagccttcaccttttggtgccttcgtttcctcatttagcacctacctcctagagctgttttgggagtcaaatgcgctgacgtatataaagtgctttgcaagatc

SEQ ID NO: 285956 - DNA, 1571 bp, Homo sapiens
cctgtggacacttgtagagtctggggaaaggttccgggcataagtggggggcatgggaatcggcctcccctgctcctcatgttacttccttaagtcatcacaatagccctgaaaagcaaaggcctcatctccatggcacaggtgatgaaacaggaagactgaagcccaggcctggccggcccacggccacattcaggccaacagaccatccctccttccacagaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaagggaagcctccagagagcacagatgtgaaccctcagcagcaggcatcaccccccagtggactcgggtgggccaccagtagcatcttctagatggcagaggggtgaatggcagggccaggaaccaggctgcccgggttcccattctgcttctgccacttccagctgtgtggctttaggtgagccttcaccttttggtgccttcgtttcctcatttagcacctacctcctagagctgttttgggagtcaaatgcgctgacgtatataaagtgctttgcaagatc

SEQ ID NO: 285957 - DNA, 2136 bp, Homo sapiens
tcaggctagtaccgatctcgggaatataggattctacggcaagctgcgtagcggctgtgggtgcttcactatggcgacggtgggggctccgcggcacttctgccgctgcgcctgcttctgcaccgataacttgtacgtggcgcgctatgggctgcacgtgcgcttccgaggcgagcagcagctgcgccgggactacggcccgatcctgcgcagccgaggctgtgttagcgccaaggacttccagcagctgttagcagagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcgggggtgaggtcctggccctgagacctggcaggaccagggaatggcagcctgggaaacctgggtgtgggatgctggggtccctccagccaccatctctgcctccaaaaaccaaaccagcaggagctggaagggtcagtgggaccaacctgccaggagcaggacatccgcattcattcattcaatacctgccatgagcctgccctgaaaagcaaaggcctcatctccatggcacaggtgatgaaacaggaagactgaagcccaggcctggccggcccacggccacattcaggccaacagaccatccctccttccacagaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaagggaagcctccagagagcacagatgtgaaccctcagcagcaggcatcaccccccagtggactcgggtgggccaccagtagcatcttctagatggcagaggggtgaatggcagggccaggaaccaggctgcccgggttcccattctgcttctgccacttccagctgtgtggctttaggtgagccttcaccttttggtgccttcgtttcctcatttagcacctacctcctagagctgttttgggagtcaaatgcgctgacgtatataaagtgctttgcaagatc

SEQ ID NO: 285958 - DNA, 2061 bp, Homo sapiens
aaggctaggtagaggcctgggtggtgaattcgccgagccggggtagatgctaaatccaaactgaaacgtacagggctggatgattgaagcaccagcgggaactagtcggacctccgagctctttaaactgtcctcagctcggctggttctccacgagctccgggcagacggcggggggtgggtcggcgtttaagtcaaaggccttggggctccgagtcccttcctctccccgtcctgtgaaggcacgacccagttcagctgtctgtaaagtggagccattagtccctgcctcgtagtgggaaaactgggaggcggaacgaggaggccgccggtcccaacccggcccaggagcatctttctccgcagaccgtttcctggcgagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcggccctgaaaagcaaaggcctcatctccatggcacaggtgatgaaacaggaagactgaagcccaggcctggccggcccacggccacattcaggccaacagaccatccctccttccacagaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaagggaagcctccagagagcacagatgtgaaccctcagcagcaggcatcaccccccagtggactcgggtgggccaccagtagcatcttctagatggcagaggggtgaatggcagggccaggaaccaggctgcccgggttcccattctgcttctgccacttccagctgtgtggctttaggtgagccttcaccttttggtgccttcgtttcctcatttagcacctacctcctagagctgttttgggagtcaaatgcgctgacgtatataaagtgctttgcaagatc

SEQ ID NO: 285959 - DNA, 1230 bp, Homo sapiens
tcaggctagtaccgatctcgggaatataggattctacggcaagctgcgtagcggctgtgggtgcttcactatggcgacggtgggggctccgcggcacttctgccgctgcgcctgcttctgcaccgataacttgtacgtggcgcgctatgggctgcacgtgcgcttccgaggcgagcagcagctgcgccgggactacggcccgatcctgcgcagccgaggctgtgttagcgccaaggacttccagcagctgttagcagagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcgggggtgaggtcctggccctgagacctggcaggaccagggaatggcagcctgggaaacctgggtgtgggatgctggggtccctccagccaccatctctgcctccaaaaaccaaaccagcaggagctggaagggtcagtgggaccaacctgccaggagcaggacatccgcattcattcattcaatacctgccatgagcctggtatcttcattctttccttcacccttccttcgtgccctcatccagcaaatagtggatatttgtgtcatgtgtgggacagctggcacactcaaacagggctgatccaagatcttaaagggaccattgagacaggtatgggcaggataaagggaccagtaaggaatggcaaagcccggccccccagggctggcaacaggagggagcagttaccacctggagttgtggctctgggcggagcctgcggccatgccaaactccaagtagggcaaaaaatgccccacttctcttcggatttcttgctgggctcacttattggctaaacccagcaggaaatgctgggcaagggaggtttgcgtgttgtttaacctctgattcagtttcctcatctgtaaaatgggagcaacagtaaccccctctcttaaggcactgcgacgatcaagtgagttaatctgcatagagtgcctgtcacagggcccgcacgtagtgtttggaaagtgtttcctattcttattggcactgatagcctgggctaggggctcctgtgggaggcagatacaag

SEQ ID NO: 285960 - DNA, 855 bp, Homo sapiens
ggagacactcactggggcaatctgaggtaatccaacagactgtggcggagggaccggaagcgccaggcagggacccggggtagatgctaaatccaaactgaaacgtacagggctggatgattgaagcaccagcgggaactagtcggacctccgagctctttaaactgtcctcagctcggctggttctccacgagctccgggcagacggcggggggtgggtcggcgtttaagtcaaaggccttggggctccgagtcccttcctctccccgtcctgtgaaggcacgacccagttcagctgtctgtaaagtggagccattagtccctgcctcgtagtgggaaaactgggaggcggaacgaggaggccgccggtcccaacccggcccaggagcatctttctccgcagaccgtttcctggcgagatcctgcgcagccgaggctgtgttagcgccaaggacttccagcagctgttagcagagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcggggcccagcaagaaagaacagccccttctggccttcctgctgggggacagaggctcccagagccacttctgagttggggtacagacttcggtggctcatcagatgaaaggaggtgcagagagagcctgaagttggctctgtgatcccgacttggctgtcactggcc

SEQ ID NO: 285961 - DNA, 2150 bp, Homo sapiens
aaggctaggtagaggcctgggtggtgaattcgccgagccggggtagatgctaaatccaaactgaaacgtacagggctggatgattgaagcaccagcgggaactagtcggacctccgagctctttaaactgtcctcagctcggctggttctccacgagctccgggcagacggcggggggtgggtcggcgtttaagtcaaaggccttggggctccgagtcccttcctctccccgtcctgtgaaggcacgacccagttcagctgtctgtaaagtggagccattagtccctgcctcgtagtgggaaaactgggaggcggaacgaggaggccgccggtcccaacccggcccaggagcatctttctccgcagaccgtttcctggcgagatcctgcgcagccgaggctgtgttagcgccaaggacttccagcagctgttagcagaggctgctgccagggctgctgccccgctccctcctcctccttcccctggagtcagtggtgggaagcttcccaggagagtcctcagcaacctctggaacacaggacttggccatgactgtctcctgtccctgtgtgggcccagatggttgagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcggaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaagggaagcctccagagagcacagatgtgaaccctcagcagcaggcatcaccccccagtggactcgggtgggccaccagtagcatcttctagatggcagaggggtgaatggcagggccaggaaccaggctgcccgggttcccattctgcttctgccacttccagctgtgtggctttaggtgagccttcaccttttggtgccttcgtttcctcatttagcacctacctcctagagctgttttgggagtcaaatgcgctgacgtatataaagtgctttgcaagatc

SEQ ID NO: 285962 - DNA, 1619 bp, Homo sapiens
tcaggctagtaccgatctcgggaatataggattctacggcaagctgcgtagcggctgtgggtgcttcactatggcgacggtgggggctccgcggcacttctgccgctgcgcctgcttctgcaccgataacttgtacgtggcgcgctatgggctgcacgtgcgcttccgaggcgagcagcagctgcgccgggactacggcccgatcctgcgcagccgaggctgtgttagcgccaaggacttccagcagctgttagcagagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcggaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataattccagctgtgtggctttaggtgagccttcaccttttggtgccttcgtttcctcatttagcacctacctcctagagctgttttgggagtcaaatgcgctgacgtatataaagtgctttgcaagatc

SEQ ID NO: 285963 - DNA, 2038 bp, Homo sapiens
ggagacactcactggggcaatctgaggtaatccaacagactgtggcggagggaccggaagcgccaggcagggacccggggtagatgctaaatccaaactgaaacgtacagggctggatgattgaagcaccagcgggaactagtcggacctccgagctctttaaactgtcctcagctcggctggttctccacgagctccgggcagacggcggggggtgggtcggcgtttaagtcaaaggccttggggctccgagtcccttcctctccccgtcctgtgaaggcacgacccagttcagctgtctgtaaagtggagccattagtccctgcctcgtagtgggaaaactgggaggcggaacgaggaggccgccggtcccaacccggcccaggagcatctttctccgcagaccgtttcctggcgagatcctgcgcagccgaggctgtgttagcgccaaggacttccagcagctgttagcagagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcggaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaagggaagcctccagagagcacagatgtgaaccctcagcagcaggcatcaccccccagtggactcgggtgggccaccagtagcatcttctagatggcagaggggtgaatggcagggccaggaaccaggctgcccgggttcccattctgcttctgccacttccagctgtgtggctttaggtgagccttcaccttttggtgccttcgtttcctcatttagcacctacctcctagagctgttttgggagtcaaatgcgctgacgtatataaagtgctttgcaagatc

SEQ ID NO: 285964 - DNA, 1215 bp, Homo sapiens
tcaggctagtaccgatctcgggaatataggattctacggcaagctgcgtagcggctgtgggtgcttcactatggcgacggtgggggctccgcggcacttctgccgctgcgcctgcttctgcaccgataacttgtacgtggcgcgctatgggctgcacgtgcgcttccgaggcgagcagcagctgcgccgggactacggcccgatcctgcgcagccgaggctgtgttagcgccaaggacttccagcagctgttagcagagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcggaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgca

SEQ ID NO: 285965 - DNA, 2197 bp, Homo sapiens
ggagacactcactggggcaatctgaggtaatccaacagactgtggcggagggaccggaagcgccaggcagggacccggggtagatgctaaatccaaactgaaacgtacagggctggatgattgaagcaccagcgggaactagtcggacctccgagctctttaaactgtcctcagctcggctggttctccacgagctccgggcagacggcggggggtgggtcggcgtttaagtcaaaggccttggggctccgagtcccttcctctccccgtcctgtgaaggcacgacccagttcagctgtctgtaaagtggagccattagtccctgcctcgtagtgggaaaactgggaggcggaacgaggaggccgccggtcccaacccggcccaggagcatctttctccgcagaccgtttcctggcgagatcctgcgcagccgaggctgtgttagcgccaaggacttccagcagctgttagcagagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcggggcccagcaagaaagaacagccccttctggccttcctgctgggggacagaggctcccagagccacttctgagttggggtgatgaaacaggaagactgaagcccaggcctggccggcccacggccacattcaggccaacagaccatccctccttccacagaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaagggaagcctccagagagcacagatgtgaaccctcagcagcaggcatcaccccccagtggactcgggtgggccaccagtagcatcttctagatggcagaggggtgaatggcagggccaggaaccaggctgcccgggttcccattctgcttctgccacttccagctgtgtggctttaggtgagccttcaccttttggtgccttcgtttcctcatttagcacctacctcctagagctgttttgggagtcaaatgcgctgacgtatataaagtgctttgcaagatc

SEQ ID NO: 285966 - DNA, 1893 bp, Homo sapiens
tcaggctagtaccgatctcgggaatataggattctacggcaagctgcgtagcggctgtgggtgcttcactatggcgacggtgggggctccgcggcacttctgccgctgcgcctgcttctgcaccgataacttgtacgtggcgcgctatgggctgcacgtgcgcttccgaggcgagcagcagctgcgccgggactacggcccgatcctgcgcagccgaggctgtgttagcgccaaggacttccagcagctgttagcagagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcggaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggtgagtgtgtgacccatgcggcagggcctggggcagctgtgagtgcccaggcctgagtcgtgccatctgcaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaagggaagcctccagagagcacagatgtgaaccctcagcagcaggcatcaccccccagtggactcgggtgggccaccagtagcatcttctagatggcagaggggtgaatggcagggccaggaaccaggctgcccgggttcccattctgcttctgccacttccagctgtgtggctttaggtgagccttcaccttttggtgccttcgtttcctcatttagcacctacctcctagagctgttttgggagtcaaatgcgctgacgtatataaagtgctttgcaagatc

SEQ ID NO: 285967 - DNA, 1846 bp, Homo sapiens
tcaggctagtaccgatctcgggaatataggattctacggcaagctgcgtagcggctgtgggtgcttcactatggcgacggtgggggctccgcggcacttctgccgctgcgcctgcttctgcaccgataacttgtacgtggcgcgctatgggctgcacgtgcgcttccgaggcgagcagcagctgcgccgggactacggcccgcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcgggtgatgaaacaggaagactgaagcccaggcctggccggcccacggccacattcaggccaacagaccatccctccttccacagaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaagggaagcctccagagagcacagatgtgaaccctcagcagcaggcatcaccccccagtggactcgggtgggccaccagtagcatcttctagatggcagaggggtgaatggcagggccaggaaccaggctgcccgggttcccattctgcttctgccacttccagctgtgtggctttaggtgagccttcaccttttggtgccttcgtttcctcatttagcacctacctcctagagctgttttgggagtcaaatgcgctgacgtatataaagtgctttgcaagatc

SEQ ID NO: 285968 - DNA, 2171 bp, Homo sapiens
aaggctaggtagaggcctgggtggtgaattcgccgagccggggtagatgctaaatccaaactgaaacgtacagggctggatgattgaagcaccagcgggaactagtcggacctccgagctctttaaactgtcctcagctcggctggttctccacgagctccgggcagacggcggggggtgggtcggcgtttaagtcaaaggccttggggctccgagtcccttcctctccccgtcctgtgaaggcacgacccagttcagctgtctgtaaagtggagccattagtccctgcctcgtagtgggaaaactgggaggcggaacgaggaggccgccggtcccaacccggcccaggagcatctttctccgcagaccgtttcctggcgagatcctgcgcagccgaggctgtgttagcgccaaggacttccagcagctgttagcagagtggcctcaggaggatgggaggccccacctggtaacaaccctgtgccaccccagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcggccctgaaaagcaaaggcctcatctccatggcacaggtgatgaaacaggaagactgaagcccaggcctggccggcccacggccacattcaggccaacagaccatccctccttccacagaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaagggaagcctccagagagcacagatgtgaaccctcagcagcaggcatcaccccccagtggactcgggtgggccaccagtagcatcttctagatggcagaggggtgaatggcagggccaggaaccaggctgcccgggttcccattctgcttctgccacttccagctgtgtggctttaggtgagccttcaccttttggtgccttcgtttcctcatttagcacctacctcctagagctgttttgggagtcaaatgcgctgacgtatataaagtgctttgcaagatc

SEQ ID NO: 285969 - DNA, 358 bp, Homo sapiens
tcaggctagtaccgatctcgggaatataggattctacggcaagctgcgtagcggctgtgggtgcttcactatggcgacggtgggggctccgcggcacttctgccgctgcgcctgcttctgcaccgataacttgtacgtggcgcgctatgggctgcacgtgcgcttccgaggcgagcagcagctgcgccgggactacggcccgatcctgcgcagccgaggctgtgttagcgccaaggacttccagcagctgttagcagagcttgagcaggaggtggagcggcggcagcggctggggcaggagtcagcagtccgttgccttggtctgggggcagaaataaaatccccgcagcctactgca

SEQ ID NO: 285970 - DNA, 2716 bp, Homo sapiens
  misc_feature (1312)..(1312): n is a, c, g, or t
ttccctcctcccgctccccgcaggggtggagcctgagcgaggagcccgcgagctctcctctctcctctgtctccgcggatgacgagtggctggataacatggagtcgggcaagatggcgcctcccaagaacgctccgagagatgccttggtgatggcacagatcctgaaggatatgggaatcacagagtatgaaccaagggttataaatcaaatgttggaatttgctttccgttatgtgactacaattctggatgatgcaaaaatttattcgagccatgctaagaaacctaatgttgatgcagatgatgtgagactggcaatccagtgtcgtgctgaccaatcttttacctctcctcccccaagagattttttactggatatcgcaaggcagaaaaatcaaacccctttgccactgattaagccatatgcaggacctagactgccacctgatagatactgcttaacagctccaaactataggctgaagtccttaattaaaaagggacctaaccaagggagactagttccacgattaagtgttggtgctgttagtagcaaacctactactcctactatagcaaccccacaaacggtgtctgtcccaaataaagttgcaactccaatgtcagtgacaagccaaagatttacggtgcagattccaccttctcagtccacacctgtcaaaccagttcctgcaacaactgcagttcaaaatgttctgattaatccttcaatgattgggcccaaaaatattcttattaccaccaacatggtttcgtcacagaacacagccaatgaagcaaacccactgaagagaaaacatgaagatgatgatgacaatgatattatgtaaggaatatagtctagtctagatgcatttcaaaaggaaagttggttttgagcccagtatactgaactagaatattctagatcttgttttaccttaaaagactgaaatgtagctgcagtatttttcgtcagttaaaactgttagatctctttagtaaacatacaaatgtgtttttcagtaggcttcaattacaaacagttaagtacttgtttcttaatagtttcattaatgttgagtcctaatatggcaattctgtttttgagacacttttctgccttctatcactgatagtagcatttaagtttcagattctacagcctagtcagcagatttatctttgacagcataatttctgatctacatttaaatactactttattttataaggtaatatagttacttactgtcactagctaatttttttttttttaccaaatctctcaatataggaaacatttttnggaaaggatggatttagaggagagattctaaatccattttggatgtatttgtttctttgacttccttaacttccaaactcaactccctttctagatcccattcattttctgcacctcccccataggcttgtttctctccattgctattaaatgtagaaggccatacctggaattttaaaaatattattcctggtaatacagctcagtgtcattttcctatttttaaaacatgctctacatgcctaatgttttgtgattcactttaacctgatggtttgcatttgctgtttttcactcttatgtcagagcagttgggttttaccccttagtttttatgcctgttaagctttactgtgcttttgacaggtagttttgggtcagttatattcagttttagtattgtattccaagttgataactcttccatgtttcacatttctaaatttaacagagatgctgtagcttaaaacatgttttgataagtaattacactggacctaggcaaaaccactgaagaacaagtgttcctttttaccacatacatattatgttttgatcactgctgcttgagccccgctattggtataattcagatcattttagcttgttgctgaggatgtcacatataagacaggatcaaacctgaaagacactaatggttcatcctctataaggccaacaaagaaaacaaattaatgtgatgtaacttgcatttatgtgcactctgcataggtttcccaataatactgtaatgttgctgaacacctttccctgttttccatttatacacatattaaagtcatattgggaaagatggcaaagcttttgagaatataaacacacctgttttgtttttcttaagttcaacatacttttgtagaatttgtaaaataaatgttcgtatcataattgagaatttatagccaaggatcctcaaaacagaagtttcatcttaggatagtgtttgatatatctaagaaagtccagtaacagagaagaaatgtctcaaatgtctcgtatcagttttagtgtttttcagtattagggaaaggtaatataaaaacaggtaaaatgtataaaaatagacctgatcaacatcataggagataaatattcattatatagcataggatattattacttgaatgttctcagggaggcagcaagtcagaaggcctaggttctagtcctagctccatcatttaccaactgtgtgaccttacttcacctcttagccttgttctcctcactagcagtaggaaagtaacacctaccctgcctacctcacagggctgttgtgagggttcaattggtatatgtgaaaattctttcagaattgtaaaatgctatatgactgtaaggaattattgcatttgttccaaggttaataaaaatttgagctta

SEQ ID NO: 285971 - DNA, 2757 bp, Homo sapiens
  misc_feature (1353)..(1353): n is a, c, g, or t
gcgtcgacttttttttttttgatacgagcaactgggtcagcacttgaaccacttgcagcaggagaaaaaccatgaaatgaccaactaagttaaagactaccaataggctctctctccggatgacgagtggctggataacatggagtcgggcaagatggcgcctcccaagaacgctccgagagatgccttggtgatggcacagatcctgaaggatatgggaatcacagagtatgaaccaagggttataaatcaaatgttggaatttgctttccgttatgtgactacaattctggatgatgcaaaaatttattcgagccatgctaagaaacctaatgttgatgcagatgatgtgagactggcaatccagtgtcgtgctgaccaatcttttacctctcctcccccaagagattttttactggatatcgcaaggcagaaaaatcaaacccctttgccactgattaagccatatgcaggacctagactgccacctgatagatactgcttaacagctccaaactataggctgaagtccttaattaaaaagggacctaaccaagggagactagttccacgattaagtgttggtgctgttagtagcaaacctactactcctactatagcaaccccacaaacggtgtctgtcccaaataaagttgcaactccaatgtcagtgacaagccaaagatttacggtgcagattccaccttctcagtccacacctgtcaaaccagttcctgcaacaactgcagttcaaaatgttctgattaatccttcaatgattgggcccaaaaatattcttattaccaccaacatggtttcgtcacagaacacagccaatgaagcaaacccactgaagagaaaacatgaagatgatgatgacaatgatattatgtaaggaatatagtctagtctagatgcatttcaaaaggaaagttggttttgagcccagtatactgaactagaatattctagatcttgttttaccttaaaagactgaaatgtagctgcagtatttttcgtcagttaaaactgttagatctctttagtaaacatacaaatgtgtttttcagtaggcttcaattacaaacagttaagtacttgtttcttaatagtttcattaatgttgagtcctaatatggcaattctgtttttgagacacttttctgccttctatcactgatagtagcatttaagtttcagattctacagcctagtcagcagatttatctttgacagcataatttctgatctacatttaaatactactttattttataaggtaatatagttacttactgtcactagctaatttttttttttttaccaaatctctcaatataggaaacatttttnggaaaggatggatttagaggagagattctaaatccattttggatgtatttgtttctttgacttccttaacttccaaactcaactccctttctagatcccattcattttctgcacctcccccataggcttgtttctctccattgctattaaatgtagaaggccatacctggaattttaaaaatattattcctggtaatacagctcagtgtcattttcctatttttaaaacatgctctacatgcctaatgttttgtgattcactttaacctgatggtttgcatttgctgtttttcactcttatgtcagagcagttgggttttaccccttagtttttatgcctgttaagctttactgtgcttttgacaggtagttttgggtcagttatattcagttttagtattgtattccaagttgataactcttccatgtttcacatttctaaatttaacagagatgctgtagcttaaaacatgttttgataagtaattacactggacctaggcaaaaccactgaagaacaagtgttcctttttaccacatacatattatgttttgatcactgctgcttgagccccgctattggtataattcagatcattttagcttgttgctgaggatgtcacatataagacaggatcaaacctgaaagacactaatggttcatcctctataaggccaacaaagaaaacaaattaatgtgatgtaacttgcatttatgtgcactctgcataggtttcccaataatactgtaatgttgctgaacacctttccctgttttccatttatacacatattaaagtcatattgggaaagatggcaaagcttttgagaatataaacacacctgttttgtttttcttaagttcaacatacttttgtagaatttgtaaaataaatgttcgtatcataattgagaatttatagccaaggatcctcaaaacagaagtttcatcttaggatagtgtttgatatatctaagaaagtccagtaacagagaagaaatgtctcaaatgtctcgtatcagttttagtgtttttcagtattagggaaaggtaatataaaaacaggtaaaatgtataaaaatagacctgatcaacatcataggagataaatattcattatatagcataggatattattacttgaatgttctcagggaggcagcaagtcagaaggcctaggttctagtcctagctccatcatttaccaactgtgtgaccttacttcacctcttagccttgttctcctcactagcagtaggaaagtaacacctaccctgcctacctcacagggctgttgtgagggttcaattggtatatgtgaaaattctttcagaattgtaaaatgctatatgactgtaaggaattattgcatttgttccaaggttaataaaaatttgagctta

SEQ ID NO: 285972 - DNA, 652 bp, Homo sapiens
agcctcctgagtagctgggaccataggctcacaacaccacacctgccaaattctccggtttgccccggaacttttgagaatataaacacacctgttttgtttttcttaagttcaacatacttttgtagaatttgtaaaataaatgttcgtatcataattgagaatttatagccaaggatcctcaaaacagaagtttcatcttaggatagtgtttgatatatctaagaaagtccagtaacagagaagaaatgtctcaaatgtctcgtatcagttttagtgtttttcagtattagggaaaggtaatataaaaacaggtaaaatgtataaaaatagacctgatcaacatcataggagataaatattcattatatagcataggatattattacttgaatgttctcagggaggcagcaagtcagaaggcctaggttctagtcctagctccatcatttaccaactgtgtgaccttacttcacctcttagccttgttctcctcactagcagtaggaaagtaacacctaccctgcctacctcacagggctgttgtgagggttcaattggtatatgtgaaaattctttcagaattgtaaaatgctatatgactgtaaggaattattgcatttgttccaaggttaataaaaatttgagctta

SEQ ID NO: 285973 - DNA, 303 bp, Homo sapiens
gcctgtgacttctgaactgcccattagctcccaacgcatgcattaaaccctcaaagaggctgggacccactccctccacgcatactcccaaatgcctgagtcatgatggcttctggtccattctgcacccccaagtgctgacccagagctccacccctccagcctcacctccaccttctcaatctcagtgactctaagtctctatactacacattacctgtcagcccgcagaatgatccctgcccgtgacttctgaactgcccattagctcccaacgcatgcattaaaccctcaaagaggctg

SEQ ID NO: 285974 - DNA, 990 bp, Homo sapiens
gattgggaccgggccccttttccaccacgcgtcataaatattagaatattactattccaatgattaaatgaggatcttgaaataaattctgaagtcttccaatttttacatttattggaggggtccctgagttctgtcaacttttttatttaagtctcttgctcttattttgtgcataaatgttaaaccttccaaaaatgaaatgttagctttctttcttttactttttattaaatttaatagaaaatatgacctgagtagttaaaaagtattttgcattatttgcagtaagatgtctctagcactgctcaaagggcaaattttaaaacttcagtctgggtgaaagatttgctagttttacagaaagatttgctatcttaaactcaagctggtttttctgttctcatgtaagtgactgggatgctgtcttatgaattcttccaaggtcatgtttgtgaaataaacattacatgagagctttcctgtcatctacactatatgttgtctggagtgttgaacaaatttattttagtttctaagttgtaatctatcctcatatggtctatacgattttgaatgtgtgccactacatactgagatgataatgctgtacaattttaagtggtagcagtttctgtatgcagtaggctgaaatattttgatgaactgcttaatttttggattttattttttaagttgtataatttattttcttgcaaaataaaaatgtaatataaaagcttttacctatccagaaaatgttgatgttctactataaaatagttacaaagagtttaattaaaatttttatagtaggtatatttttaaatttgaaggtaaattaatctcagccagccttaggaatcagaaatatgaaaagtaacccacttatttatattagacttcaaattctaattcaaaatgagagcagtcaggaatgtagcttttccactgatgatagcatgtggctatatgcctggaagaggtaat

SEQ ID NO: 285975 - DNA, 483 bp, Homo sapiens
accattaaccttccctctacacttatcatcttcactattctaattctactgactatccttgaaatggtcgccaatccgattggattttaaaaatttaggtttgttgttttaaaccataattgttctcagaacttttttggaacttcggcgaccatttcacaattttttttataaccagacaagttgtcctgcaaatattaaggagactggcagatgttatcaaatataaaataactattgggattaacatctataaacccttcttgatcaaggtatttaacagtcaattatagttaaccaagaagtaaacaaaaataacactggaatagaagaaatgtgacagtgggctggtgctattcattgaatccatgtaagtattgaactagaagagcatctgagggaattaagattgcataataaaatgtttttctgaaaggtgtaggaataattattgagtgctaatcttatattgagatgtcccat

SEQ ID NO: 285976 - DNA, 5346 bp, Homo sapiens
tcatcatttttttgcagtcaacacatatttactgggcgcattctatgcacgagttattgaagacagctgttgtaagcatttcaggacaatgcacctcccttaacaccgagtccgggatttggggcggggtgccggaaaacgccaggtcccgccagcagagggcacggtcccggcctcgctgcagcctcgggacccaccgaggcttccaggctcccacgctcgctcccgagcgcgtccccgccctcgcgtcacgtgacgtggccgcggaacctgagctgcggggcctaagccgagctaaattcgttgcaggtggccgcggcgggtgcaaccacaaaggctaatccgaaggagtcggggaggctcgtggagtcgatgcttcctcttccaagtcaggtcggctcccgttaccttctcagcattcgccgttccggtcttcctgagcgcgtgcatgaggtctttcgcgtggggaagctccggtgaccatgtaggggacaagagtgaggaagctcctggtgcttgggacgaggtcagcgctgtcggcgcgctgctccagcgcccaccacaccctggtgcgggccgacgggcctgggccctggtgggagctccggcctccggtcaaggcctggccgggagcgccacgaattctcgcgtcgtctcgcgagagtccaagttaaagaacatggcgacgtctaatctgttaaagaataaaggttctcttcagtttgaagacaaatgggattttatgcgcccgattgttttgaagcttttacgccaggaatctgttacaaaacagcagtggtttgatctgttttcggatgtgcatgcagtctgtctttgggatgataaaggcccagcaaaaattcatcaggctttaaaagaagatattcttgagtttattaagcaggcacaggcacgagtactgagccatcaagatgatacggctttgctaaaagcatatattgttgaatggcgaaagttctttacacaatgtgatattttaccaaaacctttttgtcaactagagattactttaatgggtaaacagggcagcaataaaaaatcaaatgtggaagacagtattgttcgaaagcttatgcttgatacatggaatgagtcaatcttttcaaacataaaaaacagactccaagatagtgcaatgaagctggtacatgctgagagattgggagaagcttttgattctcagctggttattggagtaagagaatcctatgttaacctttgttctaatcctgaggataaacttcaaatttatagggacaattttgagaaggcatacttggattcaacagagagattttatagaacacaagcaccctcgtatttacaacaaaatggtgtacagaattatatgaaatatgcagatgctaaattaaaagaagaagaaaaacgagcactacgttatttagaaacaagacgagaatgtaactccgttgaagcactcatggaatgctgtgtaaatgccctggtgacatcatttaaagagactatcttagctgagtgccaaggcatgatcaagagaaatgaaactgaaaaattacatttaatgttttcattgatggacaaagttcctaatggtatagagccaatgttgaaagacttggaggaacatatcattagtgctggcctggcagatatggtagcagctgctgaaactattactactgactctgagaaatacgttgagcagttacttacactatttaatagatttagtaaactcgtcaaagaagcttttcaagatgatccacgatttcttactgcaagagataaggcgtataaagcagttgttaatgatgctaccatatttaaacttgaattacctttgaagcagaagggggtgggattaaaaactcagcctgaatcaaaatgccctgagctgcttgccaattactgtgacatgttgctaagaaaaacaccattaagcaaaaaactaacctctgaagagattgaagcaaagcttaaagaagtgctcttggtacttaagtatgtacagaacaaagatgtttttatgaggtatcataaagctcatttgacacgacgtcttatattagacatctctgccgatagtgaaattgaagaaaacatggtagagtggctaagagaagttggtatgccagcggattatgtaaacaagcttgctagaatgtttcaggacataaaagtatctgaagatttgaaccaagcttttaaggaaatgcacaaaaataataaattggcattaccagctgattcagttaatataaaaattctgaatgctggcgcctggtcaagaagttctgagaaagtctttgtctcacttcctactgaactggaggacttgataccggaagtagaagaattctacaaaaaaaatcatagtggtagaaaattacattggcatcatctcatgtcaaatggaattataacatttaagaatgaagttggtcaatatgatttggaggtaaccacgtttcagctcgctgtattgtttgcatggaaccaaagacccagagagaaaatcagctttgaaaatcttaagcttgcaactgaactccctgatgctgaacttaggaggactttatggtctttagtagctttcccaaaactcaaacggcaagttttgttgtatgaacctcaagtcaactcacccaaagactttacagaaggtaccctcttctcagtgaaccaggagttcagtttaataaaaaatgcaaaggttcagaaaaggggtaaaatcaacttgattggacgtttgcagctcactacagaaaggatgagagaagaagagaatgaaggaatagttcaactacgaatactaagaacccaggaagctatcatacaaataatgaaaatgagaaagaaaattagtaatgctcagctgcagactgaattagtagaaattttgaaaaacatgttcttgccacaaaagaaaatgataaaagagcaaatagagtggctaatagagcacaaatacatcagaagagatgaatctgatatcaacactttcatatatatggcataattttgaatatcatggacaatatttagaacccaaattttggagtgcttgggcagaaagttgtaaagtttgtgctggagaaaggtttatttggactttgattacataaatattaaaatctctgccttaccttacaaaaacaactatattttgccaatcacattagttagcatgatggcattcccttcatgttgcacactctttgacagcatgctgttttgtggagaaacttgcattcatgaagagcccattatcaacttttaaaagtgaatttgatttgtacccaccaggagaaatacagttgggaagggtgagggtggggttcttgttgcttttttctcttttttcctctcttaaaaaatgtacttgcacaaggaaggatcttcagatattcatgcactgaaaaatgctgttatcttttgtttttaaaaaatgcaattaaaactagaaatagcactcttggtttcttttgatgaaaagagtgagctggtcaatgcaacattgggaaacggcagatgtagataattcagcattggcgtatttgcttgtcccaatacaagaatgccaaaggaggaaacaggaaaaattgccgtccattttaaaaatttaggtttgttgttttaaaccataattgttctcagaacttttttggaacttctaattttgggtcatttaatttaagaatgagagtcatgatgttttgatttatgaaggtgaatttaatgcaaaagtgggtaacactacattcatagcaaagttttttattaaattttataaatttttaatagccaattatgtcctaattgtattttggggaatgaacagcagcaaatactgtaaatgtacagttttctttttttttttttttggttatgtatacaaaagttttaactactttttggtgtttatgaaaatcatttagttgacaaggtgcctatgccattgttaaattttctttaagtaatttaacaacagatttgctaatttaaaaaaaaatgaaaaaaaaaatcttaccagcagtttgtaaaggtctggaatcacagttggcatcctttattcaggtctcttctctccaacgtacacttaaaattggtgccgagcagggatataacctgcagttaagtgaaaagaaaatccagcctccccctccaaaaaaaaaaaaaaaaatttaatttttaaaaattagtggtatggcaataagacacttcagaggctatcttaacctctgaatacccatcttctagtttaaagacagagacatcccatctggaaaatgttaacttgtgttgccatctcgttgccggagtaagtagacataagacagagtttaagaagtaaaaatatagaaaaattttgatggtcacaatgagataaatattagaatattactattccaatgattaaatgaggatcttgaaataaattctgaagtcttccaatttttacatttattggaggggtccctgagttctgtcaacttttttatttaagtctcttgctcttattttgtgcataaatgttaaaccttccaaaaatgaaatgttagctttctttcttttactttttattaaatttaatagaaaatatgacctgagtagttaaaaagtattttgcattatttgcagtaagatgtctctagcactgctcaaagggcaaattttaaaacttcagtctgggtgaaagatttgctagttttacagaaagatttgctatcttaaactcaagctggtttttctgttctcatgtaagtgactgggatgctgtcttatgaattcttccaaggtcatgtttgtgaaataaacattacatgagagctttcctgtcatctacactatatgttgtctggagtgttgaacaaatttattttagtttctaagttgtaatctatcctcatatggtctatacgattttgaatgtgtgccactacatactgagatgataatgctgtacaattttaagtggtagcagtttctgtatgcagtaggctgaaatattttgatgaactgcttaatttttggattttattttttaagttgtataatttattttcttgcaaaataaaaatgtaatataaaagcttttacctatccagaaaatgttgatgttctactataaaatagttacaaagagtttaattaaaatttttatagtaggtatatttttaaatttgaaggtaaattaatctcagccagccttaggaatcagaaatatgaaaagtaacccacttatttatattagacttcaaattctaattcaaaatgagagcagtcaggaatgtagcttttccactgatgatagcatgtggctatatgcctggaagaggtaat

SEQ ID NO: 285977 - DNA, 5325 bp, Homo sapiens
tcatcatttttttgcagtcaacacatatttactgggcgcattctatgcacgagttattgaagacagctgttgtaagcatttcaggacaatgcacctcccttaacaccgagtccgggatttggggcggggtgccggaaaacgccaggtcccggcctcgctgcagcctcgggacccaccgaggcttccaggctcccacgctcgctcccgagcgcgtccccgccctcgcgtcacgtgacgtggccgcggaacctgagctgcggggcctaagccgagctaaattcgttgcaggtggccgcggcgggtgcaaccacaaaggctaatccgaaggagtcggggaggctcgtggagtcgatgcttcctcttccaagtcaggtcggctcccgttaccttctcagcattcgccgttccggtcttcctgagcgcgtgcatgaggtctttcgcgtggggaagctccggtgaccatgtaggggacaagagtgaggaagctcctggtgcttgggacgaggtcagcgctgtcggcgcgctgctccagcgcccaccacaccctggtgcgggccgacgggcctgggccctggtgggagctccggcctccggtcaaggcctggccgggagcgccacgaattctcgcgtcgtctcgcgagagtccaagttaaagaacatggcgacgtctaatctgttaaagaataaaggttctcttcagtttgaagacaaatgggattttatgcgcccgattgttttgaagcttttacgccaggaatctgttacaaaacagcagtggtttgatctgttttcggatgtgcatgcagtctgtctttgggatgataaaggcccagcaaaaattcatcaggctttaaaagaagatattcttgagtttattaagcaggcacaggcacgagtactgagccatcaagatgatacggctttgctaaaagcatatattgttgaatggcgaaagttctttacacaatgtgatattttaccaaaacctttttgtcaactagagattactttaatgggtaaacagggcagcaataaaaaatcaaatgtggaagacagtattgttcgaaagcttatgcttgatacatggaatgagtcaatcttttcaaacataaaaaacagactccaagatagtgcaatgaagctggtacatgctgagagattgggagaagcttttgattctcagctggttattggagtaagagaatcctatgttaacctttgttctaatcctgaggataaacttcaaatttatagggacaattttgagaaggcatacttggattcaacagagagattttatagaacacaagcaccctcgtatttacaacaaaatggtgtacagaattatatgaaatatgcagatgctaaattaaaagaagaagaaaaacgagcactacgttatttagaaacaagacgagaatgtaactccgttgaagcactcatggaatgctgtgtaaatgccctggtgacatcatttaaagagactatcttagctgagtgccaaggcatgatcaagagaaatgaaactgaaaaattacatttaatgttttcattgatggacaaagttcctaatggtatagagccaatgttgaaagacttggaggaacatatcattagtgctggcctggcagatatggtagcagctgctgaaactattactactgactctgagaaatacgttgagcagttacttacactatttaatagatttagtaaactcgtcaaagaagcttttcaagatgatccacgatttcttactgcaagagataaggcgtataaagcagttgttaatgatgctaccatatttaaacttgaattacctttgaagcagaagggggtgggattaaaaactcagcctgaatcaaaatgccctgagctgcttgccaattactgtgacatgttgctaagaaaaacaccattaagcaaaaaactaacctctgaagagattgaagcaaagcttaaagaagtgctcttggtacttaagtatgtacagaacaaagatgtttttatgaggtatcataaagctcatttgacacgacgtcttatattagacatctctgccgatagtgaaattgaagaaaacatggtagagtggctaagagaagttggtatgccagcggattatgtaaacaagcttgctagaatgtttcaggacataaaagtatctgaagatttgaaccaagcttttaaggaaatgcacaaaaataataaattggcattaccagctgattcagttaatataaaaattctgaatgctggcgcctggtcaagaagttctgagaaagtctttgtctcacttcctactgaactggaggacttgataccggaagtagaagaattctacaaaaaaaatcatagtggtagaaaattacattggcatcatctcatgtcaaatggaattataacatttaagaatgaagttggtcaatatgatttggaggtaaccacgtttcagctcgctgtattgtttgcatggaaccaaagacccagagagaaaatcagctttgaaaatcttaagcttgcaactgaactccctgatgctgaacttaggaggactttatggtctttagtagctttcccaaaactcaaacggcaagttttgttgtatgaacctcaagtcaactcacccaaagactttacagaaggtaccctcttctcagtgaaccaggagttcagtttaataaaaaatgcaaaggttcagaaaaggggtaaaatcaacttgattggacgtttgcagctcactacagaaaggatgagagaagaagagaatgaaggaatagttcaactacgaatactaagaacccaggaagctatcatacaaataatgaaaatgagaaagaaaattagtaatgctcagctgcagactgaattagtagaaattttgaaaaacatgttcttgccacaaaagaaaatgataaaagagcaaatagagtggctaatagagcacaaatacatcagaagagatgaatctgatatcaacactttcatatatatggcataattttgaatatcatggacaatatttagaacccaaattttggagtgcttgggcagaaagttgtaaagtttgtgctggagaaaggtttatttggactttgattacataaatattaaaatctctgccttaccttacaaaaacaactatattttgccaatcacattagttagcatgatggcattcccttcatgttgcacactctttgacagcatgctgttttgtggagaaacttgcattcatgaagagcccattatcaacttttaaaagtgaatttgatttgtacccaccaggagaaatacagttgggaagggtgagggtggggttcttgttgcttttttctcttttttcctctcttaaaaaatgtacttgcacaaggaaggatcttcagatattcatgcactgaaaaatgctgttatcttttgtttttaaaaaatgcaattaaaactagaaatagcactcttggtttcttttgatgaaaagagtgagctggtcaatgcaacattgggaaacggcagatgtagataattcagcattggcgtatttgcttgtcccaatacaagaatgccaaaggaggaaacaggaaaaattgccgtccattttaaaaatttaggtttgttgttttaaaccataattgttctcagaacttttttggaacttctaattttgggtcatttaatttaagaatgagagtcatgatgttttgatttatgaaggtgaatttaatgcaaaagtgggtaacactacattcatagcaaagttttttattaaattttataaatttttaatagccaattatgtcctaattgtattttggggaatgaacagcagcaaatactgtaaatgtacagttttctttttttttttttttggttatgtatacaaaagttttaactactttttggtgtttatgaaaatcatttagttgacaaggtgcctatgccattgttaaattttctttaagtaatttaacaacagatttgctaatttaaaaaaaaatgaaaaaaaaaatcttaccagcagtttgtaaaggtctggaatcacagttggcatcctttattcaggtctcttctctccaacgtacacttaaaattggtgccgagcagggatataacctgcagttaagtgaaaagaaaatccagcctccccctccaaaaaaaaaaaaaaaaatttaatttttaaaaattagtggtatggcaataagacacttcagaggctatcttaacctctgaatacccatcttctagtttaaagacagagacatcccatctggaaaatgttaacttgtgttgccatctcgttgccggagtaagtagacataagacagagtttaagaagtaaaaatatagaaaaattttgatggtcacaatgagataaatattagaatattactattccaatgattaaatgaggatcttgaaataaattctgaagtcttccaatttttacatttattggaggggtccctgagttctgtcaacttttttatttaagtctcttgctcttattttgtgcataaatgttaaaccttccaaaaatgaaatgttagctttctttcttttactttttattaaatttaatagaaaatatgacctgagtagttaaaaagtattttgcattatttgcagtaagatgtctctagcactgctcaaagggcaaattttaaaacttcagtctgggtgaaagatttgctagttttacagaaagatttgctatcttaaactcaagctggtttttctgttctcatgtaagtgactgggatgctgtcttatgaattcttccaaggtcatgtttgtgaaataaacattacatgagagctttcctgtcatctacactatatgttgtctggagtgttgaacaaatttattttagtttctaagttgtaatctatcctcatatggtctatacgattttgaatgtgtgccactacatactgagatgataatgctgtacaattttaagtggtagcagtttctgtatgcagtaggctgaaatattttgatgaactgcttaatttttggattttattttttaagttgtataatttattttcttgcaaaataaaaatgtaatataaaagcttttacctatccagaaaatgttgatgttctactataaaatagttacaaagagtttaattaaaatttttatagtaggtatatttttaaatttgaaggtaaattaatctcagccagccttaggaatcagaaatatgaaaagtaacccacttatttatattagacttcaaattctaattcaaaatgagagcagtcaggaatgtagcttttccactgatgatagcatgtggctatatgcctggaagaggtaat

SEQ ID NO: 285978 - DNA, 4565 bp, Homo sapiens
tcatcatttttttgcagtcaacacatatttactgggcgcattctatgcacgagttattgaagacagctgttgtaagcatttcaggacaatgcacctcccttaacaccgagtccgggatttggggcggggtgccggaaaacgccaggtcccgccagcagagggcacggtcccggcctcgctgcagcctcgggacccaccgaggcttccaggctcccacgctcgctcccgagcgcgtccccgccctcgcgtcacgtgacgtggccgcggaacctgagctgcggggcctaagccgagctaaattcgttgcaggtggccgcggcgggtgcaaccacaaaggctaatccgaaggagtcggggaggctcgtggagtcgatgcttcctcttccaagtcaggtcggctcccgttaccttctcagcattcgccgttccggtcttcctgagcgcgtgcatgaggtctttcgcgtggggaagctccggtgaccatgtaggggacaagagtgaggaagctcctggtgcttgggacgaggtcagcgctgtcggcgcgctgctccagcgcccaccacaccctggtgcgggccgacgggcctgggccctggtgggagctccggcctccggtcaaggcctggccgggagcgccacgaattctcgcgtcgtctcgcgagagtccaagttaaagaacatggcgacgtctaatctgttaaagaataaaggttctcttcagtttgaagacaaatgggattttatgcgcccgattgttttgaagcttttacgccaggaatctgttacaaaacagcagtggtttgatctgttttcggatgtgcatgcagtctgtctttgggatgataaaggcccagcaaaaattcatcaggctttaaaagaagatattcttgagtttattaagcaggcacaggcacgagtactgagccatcaagatgatacggctttgctaaaagcatatattgttgaatggcgaaagttctttacacaatgtgatattttaccaaaacctttttgtcaactagagattactttaatgggtaaacagggcagcaataaaaaatcaaatgtggaagacagtattgttcgaaagcttatgcttgatacatggaatgagtcaatcttttcaaacataaaaaacagactccaagatagtgcaatgaagctggtacatgctgagagattgggagaagcttttgattctcagctggttattggagtaagagaatcctatgttaacctttgttctaatcctgaggataaacttcaaatttatagggacaattttgagaaggcatacttggattcaacagagagattttatagaacacaagcaccctcgtatttacaacaaaatggtgtacagaattatatgaaatatgcagatgctaaattaaaagaagaagaaaaacgagcactacgttatttagaaacaagacgagaatgtaactccgttgaagcactcatggaatgctgtgtaaatgccctggtgacatcatttaaagagactatcttagctgagtgccaaggcatgatcaagagaaatgaaactgaaaaattacatttaatgttttcattgatggacaaagttcctaatggtatagagccaatgttgaaagacttggaggaacatatcattagtgctggcctggcagatatggtagcagctgctgaaactattactactgactctgagaaatacgttgagcagttacttacactatttaatagatttagtaaactcgtcaaagaagcttttcaagatgatccacgatttcttactgcaagagataaggcgtataaagcagttgttaatgatgctaccatatttaaacttgaattacctttgaagcagaagggggtgggattaaaaactcagcctgaatcaaaatgccctgagctgcttgccaattactgtgacatgttgctaagaaaaacaccattaagcaaaaaactaacctctgaagagattgaagcaaagcttaaagaagtgctcttggtacttaagtatgtacagaacaaagatgtttttatgaggtatcataaagctcatttgacacgacgtcttatattagacatctctgccgatagtgaaattgaagaaaacatggtagagtggctaagagaagttggtatgccagcggattatgtaaacaagcttgctagaatgtttcaggacataaaagtatctgaagatttgaaccaagcttttaaggaaatgcacaaaaataataaattggcattaccagctgattcagttaatataaaaattctgaatgctggcgcctggtcaagaagttctgagaaagtctttgtctcacttcctactgaactggaggacttgataccggaagtagaagaattctacaaaaaaaatcatagtggtagaaaattacattggcatcatctcatgtcaaatggaattataacatttaagaatgaagttggtcaatatgatttggaggtaaccacgtttcagctcgctgtattgtttgcatggaaccaaagacccagagagaaaatcagctttgaaaatcttaagcttgcaactgaactccctgatgctgaacttaggaggactttatggtctttagtagctttcccaaaactcaaacggcaagttttgttgtatgaacctcaagtcaactcacccaaagactttacagaaggtaccctcttctcagtgaaccaggagttcagtttaataaaaaatgcaaaggttcagaaaaggggtaaaatcaacttgattggacgtttgcagctcactacagaaaggatgagagaagaagagaatgaaggaatagttcaactacgaatactaagaacccaggaagctatcatacaaataatgaaaatgagaaagaaaattagtaatgctcagctgcagactgaattagtagaaattttgaaaaacatgttcttgccacaaaagaaaatgataaaagagcaaatagagtggctaatagagcacaaatacatcagaagagatgaatctgatatcaacactttcatatatatggcataattttgaatatcatggacaatatttagaacccaaattttggagtgcttgggcagaaagttgtaaagtttgtgctggagaaaggtttatttggactttgattacataaatattaaaatctctgccttaccttacaaaaacaactatattttgccaatcacattagttagcatgatggcattcccttcatgttgcacactctttgacagcatgctgttttgtggagaaacttgcattcatgaagagcccattatcaacttttaaaagtgaatttgatttgtacccaccaggagaaatacagttgggaagggtgagggtggggttcttgttgcttttttctcttttttcctctcttaaaaaatgtacttgcacaaggaaggatcttcagatattcatgcactgaaaaatgctgttatcttttgtttttaaaaaatgcaattaaaactagaaatagcactcttggtttcttttgatgaaaagagtgagctggtcaatgcaacattgggaaacggcagatgtagataattcagcattggcgtatttgcttgtcccaatacaagaatgccaaaggaggaaacaggaaaaattgccgtccattttaaaaatttaggtttgttgttttaaaccataattgttctcagaacttttttggaacttctaattttgggtcatttaatttaagaatgagagtcatgatgttttgatttatgaaggtgaatttaatgcaaaagtgggtaacactacattcatagcaaagttttttattaaattttataaatttttaatagccaattatgtcctaattgtattttggggaatgaacagcagcaaatactgtaaatgtacagttttctttttttttttttttggttatgtatacaaaagttttaactactttttggtgtttatgaaaatcatttagttgacaaggtgcctatgccattgttaaattttctttaagtaatttaacaacagatttgctaatttaaaaaaaaatgaaaaaaaaaatcttaccagcagtttgtaaaggtctggaatcacagttggcatcctttattcaggtctcttctctccaacgtacacttaaaattggtgccgagcagggatataacctgcagttaagtgaaaagaaaatccagcctccccctccaaaaaaaaaaaaaaaaatttaatttttaaaaattagtggtatggcaataagacacttcagaggctatcttaacctctgaatacccatcttctagtttaaagacagagacatcccatctggaaaatgttaacttgtgttgccatctcgttgccggagtaagtagacataagacagagtttaagaagtaaaaatatagaaaaattttgatggtcacaatgagataaatattagaatattactattccaatgattaaatgaggatcttgaaataaattctgaagtcttccaatttttacatttattggaggggtccctgagttctgtcaacttttttatttaagtctcttgctcttattttgtgcataaatgtctaatagggagatgtctcatatggga

SEQ ID NO: 285979 - DNA, 3155 bp, Homo sapiens
tcatcatttttttgcagtcaacacatatttactgggcgcattctatgcacgagttattgaagacagctgttgtaagcatttcaggacaatgcacctcccttaacaccgagtccgggatttggggcggggtgccggaaaacgccaggtcccgccagcagagggcacggtcccggcctcgctgcagcctcgggacccaccgaggcttccaggctcccacgctcgctcccgagcgcgtccccgccctcgcgtcacgtgacgtggccgcggaacctgagctgcggggcctaagccgagctaaattcgttgcaggtggccgcggcgggtgcaaccacaaaggctaatccgaaggagtcggggaggctcgtggagtcgatgcttcctcttccaagtcaggtcggctcccgttaccttctcagcattcgccgttccggtcttcctgagcgcgtgcatgaggtctttcgcgtggggaagctccggtgaccatgtaggggacaagagtgaggaagctcctggtgcttgggacgaggtcagcgctgtcggcgcgctgctccagcgcccaccacaccctggtgcgggccgacgggcctgggccctggtgggagctccggcctccggtcaaggcctggccgggagcgccacgaattctcgcgtcgtctcgcgagagtccaagttaaagaacatggcgacgtctaatctgttaaagaataaaggttctcttcagtttgaagacaaatgggattttatgcgcccgattgttttgaagcttttacgccaggaatctgttacaaaacagcagtggtttgatctgttttcggatgtgcatgcagtctgtctttgggatgataaaggcccagcaaaaattcatcaggctttaaaagaagatattcttgagtttattaagcaggcacaggcacgagtactgagccatcaagatgatacggctttgctaaaagcatatattgttgaatggcgaaagttctttacacaatgtgatattttaccaaaacctttttgtcaactagagattactttaatgggtaaacagggcagcaataaaaaatcaaatgtggaagacagtattgttcgaaagcttatgcttgatacatggaatgagtcaatcttttcaaacataaaaaacagactccaagatagtgcaatgaagctggtacatgctgagagattgggagaagcttttgattctcagctggttattggagtaagagaatcctatgttaacctttgttctaatcctgaggataaacttcaaatttatagggacaattttgagaaggcatacttggattcaacagagagattttatagaacacaagcaccctcgtatttacaacaaaatggtgtacagaattatatgaaatatgcagatgctaaattaaaagaagaagaaaaacgagcactacgttatttagaaacaagacgagaatgtaactccgttgaagcactcatggaatgctgtgtaaatgccctggtgacatcatttaaagagactatcttagctgagtgccaaggcatgatcaagagaaatgaaactgaaaaattacatttaatgttttcattgatggacaaagttcctaatggtatagagccaatgttgaaagacttggaggaacatatcattagtgctggcctggcagatatggtagcagctgctgaaactattactactgactctgagaaatacgttgagcagttacttacactatttaatagatttagtaaactcgtcaaagaagcttttcaagatgatccacgatttcttactgcaagagataaggcgtataaagcagttgttaatgatgctaccatatttaaacttgaattacctttgaagcagaagggggtgggattaaaaactcagcctgaatcaaaatgccctgagctgcttgccaattactgtgacatgttgctaagaaaaacaccattaagcaaaaaactaacctctgaagagattgaagcaaagcttaaagaagtgctcttggtacttaagtatgtacagaacaaagatgtttttatgaggtatcataaagctcatttgacacgacgtcttatattagacatctctgccgatagtgaaattgaagaaaacatggtagagtggctaagagaagttggtatgccagcggattatgtaaacaagcttgctagaatgtttcaggacataaaagtatctgaagatttgaaccaagcttttaaggaaatgcacaaaaataataaattggcattaccagctgattcagttaatataaaaattctgaatgctggcgcctggtcaagaagttctgagaaagtctttgtctcacttcctactgaactggaggacttgataccggaagtagaagaattctacaaaaaaaatcatagtggtagaaaattacattggcatcatctcatgtcaaatggaattataacatttaagaatgaagttggtcaatatgatttggaggtaaccacgtttcagctcgctgtattgtttgcatggaaccaaagacccagagagaaaatcagctttgaaaatcttaagcttgcaactgaactccctgatgctgaacttaggaggactttatggtctttagtagctttcccaaaactcaaacggcaagttttgttgtatgaacctcaagtcaactcacccaaagactttacagaaggtaccctcttctcagtgaaccaggagttcagtttaataaaaaatgcaaaggttcagaaaaggggtaaaatcaacttgattggacgtttgcagctcactacagaaaggatgagagaagaagagaatgaaggaatagttcaactacgaatactaagaacccaggaagctatcatacaaataatgaaaatgagaaagaaaattagtaatgctcagctgcagactgaattagtagaaattttgaaaaacatgttcttgccacaaaagaaaatgataaaagagcaaatagagtggctaatagagcacaaatacatcagaagagatgaatctgatatcaacactttcatatatatggcataattttgaatatcatggacaatatttagaacccaaattttggagtgcttgggcagaaagttgtaaagtttgtgctggagaaaggtttatttggactttgattacataaatattaaaatctctgccttaccttaca

SEQ ID NO: 285980 - DNA, 5169 bp, Homo sapiens
tcatcatttttttgcagtcaacacatatttactgggcgcattctatgcacgagttattgaagacagctgttgtaagcatttcaggacaatgcacctcccttaacaccgagtccgggatttggggcggggtgccggaaaacgccaggtcccgccagcagagggcacggtcccggcctcgctgcagcctcgggacccaccgaggcttccaggctcccacgctcgctcccgagcgcgtccccgccctcgcgtcacgtgacgtggccgcggaacctgagctgcggggcctaagccgagctaaattcgttgcaggtggccgcggcgggtgcaaccacaaaggctaatccgaaggagtcggggaggctcgtggagtcgatgcttcctcttccaagtcaggtcggctcccgttaccttctcagcattcgccgttccggtcttcctgagcgcgtgcatgaggtctttcgcgtggggaagctccggtgaccatgtaggggacaagagtgaggaagctcctggtgcttgggacgaggtcagcgctgtcggcgcgctgctccagcgcccaccacaccctggtgcgggccgacgggcctgggccctggtgggagctccggcctccggtcaaggcctggccgggagcgccacgaattctcgcgtcgtctcgcgagagtccaagttaaagaacatggcgacgtctaatctgttaaagaataaaggttctcttcagtttgaagacaaatgggattttatgcgcccgattgttttgaagcttttacgccaggaatctgttacaaaacagcagtggtttgatctgttttcggatgtgcatgcagtctgtctttgggatgataaaggcccagcaaaaattcatcaggctttaaaagaagatattcttgagtttattaagcaggcacaggcacttatgcttgatacatggaatgagtcaatcttttcaaacataaaaaacagactccaagatagtgcaatgaagctggtacatgctgagagattgggagaagcttttgattctcagctggttattggagtaagagaatcctatgttaacctttgttctaatcctgaggataaacttcaaatttatagggacaattttgagaaggcatacttggattcaacagagagattttatagaacacaagcaccctcgtatttacaacaaaatggtgtacagaattatatgaaatatgcagatgctaaattaaaagaagaagaaaaacgagcactacgttatttagaaacaagacgagaatgtaactccgttgaagcactcatggaatgctgtgtaaatgccctggtgacatcatttaaagagactatcttagctgagtgccaaggcatgatcaagagaaatgaaactgaaaaattacatttaatgttttcattgatggacaaagttcctaatggtatagagccaatgttgaaagacttggaggaacatatcattagtgctggcctggcagatatggtagcagctgctgaaactattactactgactctgagaaatacgttgagcagttacttacactatttaatagatttagtaaactcgtcaaagaagcttttcaagatgatccacgatttcttactgcaagagataaggcgtataaagcagttgttaatgatgctaccatatttaaacttgaattacctttgaagcagaagggggtgggattaaaaactcagcctgaatcaaaatgccctgagctgcttgccaattactgtgacatgttgctaagaaaaacaccattaagcaaaaaactaacctctgaagagattgaagcaaagcttaaagaagtgctcttggtacttaagtatgtacagaacaaagatgtttttatgaggtatcataaagctcatttgacacgacgtcttatattagacatctctgccgatagtgaaattgaagaaaacatggtagagtggctaagagaagttggtatgccagcggattatgtaaacaagcttgctagaatgtttcaggacataaaagtatctgaagatttgaaccaagcttttaaggaaatgcacaaaaataataaattggcattaccagctgattcagttaatataaaaattctgaatgctggcgcctggtcaagaagttctgagaaagtctttgtctcacttcctactgaactggaggacttgataccggaagtagaagaattctacaaaaaaaatcatagtggtagaaaattacattggcatcatctcatgtcaaatggaattataacatttaagaatgaagttggtcaatatgatttggaggtaaccacgtttcagctcgctgtattgtttgcatggaaccaaagacccagagagaaaatcagctttgaaaatcttaagcttgcaactgaactccctgatgctgaacttaggaggactttatggtctttagtagctttcccaaaactcaaacggcaagttttgttgtatgaacctcaagtcaactcacccaaagactttacagaaggtaccctcttctcagtgaaccaggagttcagtttaataaaaaatgcaaaggttcagaaaaggggtaaaatcaacttgattggacgtttgcagctcactacagaaaggatgagagaagaagagaatgaaggaatagttcaactacgaatactaagaacccaggaagctatcatacaaataatgaaaatgagaaagaaaattagtaatgctcagctgcagactgaattagtagaaattttgaaaaacatgttcttgccacaaaagaaaatgataaaagagcaaatagagtggctaatagagcacaaatacatcagaagagatgaatctgatatcaacactttcatatatatggcataattttgaatatcatggacaatatttagaacccaaattttggagtgcttgggcagaaagttgtaaagtttgtgctggagaaaggtttatttggactttgattacataaatattaaaatctctgccttaccttacaaaaacaactatattttgccaatcacattagttagcatgatggcattcccttcatgttgcacactctttgacagcatgctgttttgtggagaaacttgcattcatgaagagcccattatcaacttttaaaagtgaatttgatttgtacccaccaggagaaatacagttgggaagggtgagggtggggttcttgttgcttttttctcttttttcctctcttaaaaaatgtacttgcacaaggaaggatcttcagatattcatgcactgaaaaatgctgttatcttttgtttttaaaaaatgcaattaaaactagaaatagcactcttggtttcttttgatgaaaagagtgagctggtcaatgcaacattgggaaacggcagatgtagataattcagcattggcgtatttgcttgtcccaatacaagaatgccaaaggaggaaacaggaaaaattgccgtccattttaaaaatttaggtttgttgttttaaaccataattgttctcagaacttttttggaacttctaattttgggtcatttaatttaagaatgagagtcatgatgttttgatttatgaaggtgaatttaatgcaaaagtgggtaacactacattcatagcaaagttttttattaaattttataaatttttaatagccaattatgtcctaattgtattttggggaatgaacagcagcaaatactgtaaatgtacagttttctttttttttttttttggttatgtatacaaaagttttaactactttttggtgtttatgaaaatcatttagttgacaaggtgcctatgccattgttaaattttctttaagtaatttaacaacagatttgctaatttaaaaaaaaatgaaaaaaaaaatcttaccagcagtttgtaaaggtctggaatcacagttggcatcctttattcaggtctcttctctccaacgtacacttaaaattggtgccgagcagggatataacctgcagttaagtgaaaagaaaatccagcctccccctccaaaaaaaaaaaaaaaaatttaatttttaaaaattagtggtatggcaataagacacttcagaggctatcttaacctctgaatacccatcttctagtttaaagacagagacatcccatctggaaaatgttaacttgtgttgccatctcgttgccggagtaagtagacataagacagagtttaagaagtaaaaatatagaaaaattttgatggtcacaatgagataaatattagaatattactattccaatgattaaatgaggatcttgaaataaattctgaagtcttccaatttttacatttattggaggggtccctgagttctgtcaacttttttatttaagtctcttgctcttattttgtgcataaatgttaaaccttccaaaaatgaaatgttagctttctttcttttactttttattaaatttaatagaaaatatgacctgagtagttaaaaagtattttgcattatttgcagtaagatgtctctagcactgctcaaagggcaaattttaaaacttcagtctgggtgaaagatttgctagttttacagaaagatttgctatcttaaactcaagctggtttttctgttctcatgtaagtgactgggatgctgtcttatgaattcttccaaggtcatgtttgtgaaataaacattacatgagagctttcctgtcatctacactatatgttgtctggagtgttgaacaaatttattttagtttctaagttgtaatctatcctcatatggtctatacgattttgaatgtgtgccactacatactgagatgataatgctgtacaattttaagtggtagcagtttctgtatgcagtaggctgaaatattttgatgaactgcttaatttttggattttattttttaagttgtataatttattttcttgcaaaataaaaatgtaatataaaagcttttacctatccagaaaatgttgatgttctactataaaatagttacaaagagtttaattaaaatttttatagtaggtatatttttaaatttgaaggtaaattaatctcagccagccttaggaatcagaaatatgaaaagtaacccacttatttatattagacttcaaattctaattcaaaatgagagcagtcaggaatgtagcttttccactgatgatagcatgtggctatatgcctggaagaggtaat

SEQ ID NO: 285981 - DNA, 3811 bp, Homo sapiens
tcatcatttttttgcagtcaacacatatttactgggcgcattctatgcacgagttattgaagacagctgttgtaagcatttcaggacaatgcacctcccttaacaccgagtccgggatttggggcggggtgccggaaaacgccaggtcccgccagcagagggcacggtcccggcctcgctgcagcctcgggacccaccgaggcttccaggctcccacgctcgctcccgagcgcgtccccgccctcgcgtcacgtgacgtggccgcggaacctgagctgcggggcctaagccgagctaaattcgttgcaggtggccgcggcgggtgcaaccacaaaggctaatccgaaggagtcggggaggctcgtggagtcgatgcttcctcttccaagtcaggtcggctcccgttaccttctcagcattcgccgttccggtcttcctgagcgcgtgcatgaggtctttcgcgtggggaagctccggtgaccatgtaggggacaagagtgaggaagctcctggtgcttgggacgaggtcagcgctgtcggcgcgctgctccagcgcccaccacaccctggtgcgggccgacgggcctgggccctggtgggagctccggcctccggtcaaggcctggccgggagcgccacgaattctcgcgtcgtctcgcgagagtccaagttaaagaacatggcgacgtctaatctgttaaagaataaaggttctcttcagtttgaagacaaatgggattttatgcgcccgattgttttgaagcttttacgccaggaatctgttacaaaacagcagtggtttgatctgttttcggatgtgcatgcagtctgtctttgggatgataaaggcccagcaaaaattcatcaggctttaaaagaagatattcttgagtttattaagcaggcacaggcacgagtactgagccatcaagatgatacggctttgctaaaagcatatattgttgaatggcgaaagttctttacacaatgtgatattttaccaaaacctttttgtcaactagagattactttaatgggtaaacagggcagcaataaaaaatcaaatgtggaagacagtattgttcgaaagcttatgcttgatacatggaatgagtcaatcttttcaaacataaaaaacagactccaagatagtgcaatgaagctggtacatgctgagagattgggagaagcttttgattctcagctggttattggagtaagagaatcctatgttaacctttgttctaatcctgaggataaacttcaaatttatagggacaattttgagaaggcatacttggattcaacagagagattttatagaacacaagcaccctcgtatttacaacaaaatggtgtacagaattatatgaaatatgcagatgctaaattaaaagaagaagaaaaacgagcactacgttatttagaaacaagacgagaatgtaactccgttgaagcactcatggaatgctgtgtaaatgccctggtgacatcatttaaagagactatcttagctgagtgccaaggcatgatcaagagaaatgaaactgaaaaattacatttaatgttttcattgatggacaaagttcctaatggtatagagccaatgttgaaagacttggaggaacatatcattagtgctggcctggcagatatggtagcagctgctgaaactattactactgactctgagaaatacgttgagcagttacttacactatttaatagatttagtaaactcgtcaaagaagcttttcaagatgatccacgatttcttactgcaagagataaggcgtataaagcagttgttaatgatgctaccatatttaaacttgaattacctttgaagcagaagggggtgggattaaaaactcagcctgaatcaaaatgccctgagctgcttgccaattactgtgacatgttgctaagaaaaacaccattaagcaaaaaactaacctctgaagagattgaagcaaagcttaaagaagtgctcttggtacttaagtatgtacagaacaaagatgtttttatgaggtatcataaagctcatttgacacgacgtcttatattagacatctctgccgatagtgaaattgaagaaaacatggtagagtggctaagagaagttggtatgccagcggattatgtaaacaagcttgctagaatgtttcaggacataaaagtatctgaagatttgaaccaagcttttaaggaaatgcacaaaaataataaattggcattaccagctgattcagttaatataaaaattctgaatgctggcgcctggtcaagaagttctgagaaagtctttgtctcacttcctactgaactggaggacttgataccggaagtagaagaattctacaaaaaaaatcatagtggtagaaaattacattggcatcatctcatgtcaaatggaattataacatttaagaatgaagttggtcaatatgatttggaggtaaccacgtttcagctcgctgtattgtttgcatggaaccaaagacccagagagaaaatcagctttgaaaatcttaagcttgcaactgaactccctgatgctgaacttaggaggactttatggtctttagtagctttcccaaaactcaaacggcaagttttgttgtatgaacctcaagtcaactcacccaaagactttacagaaggtaccctcttctcagtgaaccaggagttcagtttaataaaaaatgcaaaggttcagaaaaggggtaaaatcaacttgattggacgtttgcagctcactacagaaaggatgagagaagaagagaatgaaggaatagttcaactacgaatactaagaacccaggaagctatcatacaaataatgaaaatgagaaagaaaattagtaatgctcagctgcagactgaattagtagaaattttgaaaaacatgttcttgccacaaaagaaaatgataaaagagcaaatagagtggctaatagagcacaaatacatcagaagagatgaatctgatatcaacactttcatatatatggcataattttgaatatcatggacaatatttagaacccaaattttggagtgcttgggcagaaagttgtaaagtttgtgctggagaaaggtttatttggactttgattacataaatattaaaatctctgccttaccttacaaaaacaactatattttgccaatcacattagttagcatgatggcattcccttcatgttgcacactctttgacagcatgctgttttgtggagaaacttgcattcatgaagagcccattatcaacttttaaaagtgaatttgatttgtacccaccaggagaaatacagttgggaagggtgagggtggggttcttgttgcttttttctcttttttcctctcttaaaaaatgtacttgcacaaggaaggatcttcagatattcatgcactgaaaaatgctgttatcttttgtttttaaaaaatgcaattaaaactagaaatagcactcttggtttcttttgatgaaaagagtgagctggtcaatgcaacattgggaaacggcagatgtaggtgagaagttaagtatttaatagtatcaaattgttcaaacattgctcagtataataactggattttaatggtgacctaaaaatggtattaaatattttcaactttcaaatgttggttttctttaagcaggagactgctattttagttgttgttaaatgatgaggagtttttttttttttaaatatggctggaaagcttgttttgaaaaatgaagcttatattaattgttgcttcaatagtttaaaaaatttatggagataggtaggtcatt

SEQ ID NO: 285982 - DNA, 1890 bp, Homo sapiens
ctaattaggtgactgttcataatgggtatatttggaatttagaagaaataattttgtagtaattgtggcccttatgtttaacagataattcagcattggcgtatttgcttgtcccaatacaagaatgccaaaggaggaaacaggaaaaattgccgtccattttaaaaatttaggtttgttgttttaaaccataattgttctcagaacttttttggaacttctaattttgggtcatttaatttaagaatgagagtcatgatgttttgatttatgaaggtgaatttaatgcaaaagtgggtaacactacattcatagcaaagttttttattaaattttataaatttttaatagccaattatgtcctaattgtattttggggaatgaacagcagcaaatactgtaaatgtacagttttctttttttttttttttggttatgtatacaaaagttttaactactttttggtgtttatgaaaatcatttagttgacaaggtgcctatgccattgttaaattttctttaagtaatttaacaacagatttgctaatttaaaaaaaaatgaaaaaaaaaatcttaccagcagtttgtaaaggtctggaatcacagttggcatcctttattcaggtctcttctctccaacgtacacttaaaattggtgccgagcagggatataacctgcagttaagtgaaaagaaaatccagcctccccctccaaaaaaaaaaaaaaaaatttaatttttaaaaattagtggtatggcaataagacacttcagaggctatcttaacctctgaatacccatcttctagtttaaagacagagacatcccatctggaaaatgttaacttgtgttgccatctcgttgccggagtaagtagacataagacagagtttaagaagtaaaaatatagaaaaattttgatggtcacaatgagataaatattagaatattactattccaatgattaaatgaggatcttgaaataaattctgaagtcttccaatttttacatttattggaggggtccctgagttctgtcaacttttttatttaagtctcttgctcttattttgtgcataaatgttaaaccttccaaaaatgaaatgttagctttctttcttttactttttattaaatttaatagaaaatatgacctgagtagttaaaaagtattttgcattatttgcagtaagatgtctctagcactgctcaaagggcaaattttaaaacttcagtctgggtgaaagatttgctagttttacagaaagatttgctatcttaaactcaagctggtttttctgttctcatgtaagtgactgggatgctgtcttatgaattcttccaaggtcatgtttgtgaaataaacattacatgagagctttcctgtcatctacactatatgttgtctggagtgttgaacaaatttattttagtttctaagttgtaatctatcctcatatggtctatacgattttgaatgtgtgccactacatactgagatgataatgctgtacaattttaagtggtagcagtttctgtatgcagtaggctgaaatattttgatgaactgcttaatttttggattttattttttaagttgtataatttattttcttgcaaaataaaaatgtaatataaaagcttttacctatccagaaaatgttgatgttctactataaaatagttacaaagagtttaattaaaatttttatagtaggtatatttttaaatttgaaggtaaattaatctcagccagccttaggaatcagaaatatgaaaagtaacccacttatttatattagacttcaaattctaattcaaaatgagagcagtcaggaatgtagcttttccactgatgatagcatgtggctatatgcctggaagaggtaat

SEQ ID NO: 285983 - DNA, 1753 bp, Homo sapiens
  misc_feature (8)..(8): n is a, c, g, or t
  misc_feature (10)..(10): n is a, c, g, or t
  misc_feature (20)..(20): n is a, c, g, or t
ggcggccngnatgggacatncattttaaaaatttaggtttgttgttttaaaccataattgttctcagaacttttttggaacttctaattttgggtcatttaatttaagaatgagagtcatgatgttttgatttatgaaggtgaatttaatgcaaaagtgggtaacactacattcatagcaaagttttttattaaattttataaatttttaatagccaattatgtcctaattgtattttggggaatgaacagcagcaaatactgtaaatgtacagttttctttttttttttttttggttatgtatacaaaagttttaactactttttggtgtttatgaaaatcatttagttgacaaggtgcctatgccattgttaaattttctttaagtaatttaacaacagatttgctaatttaaaaaaaaatgaaaaaaaaaatcttaccagcagtttgtaaaggtctggaatcacagttggcatcctttattcaggtctcttctctccaacgtacacttaaaattggtgccgagcagggatataacctgcagttaagtgaaaagaaaatccagcctccccctccaaaaaaaaaaaaaaaaatttaatttttaaaaattagtggtatggcaataagacacttcagaggctatcttaacctctgaatacccatcttctagtttaaagacagagacatcccatctggaaaatgttaacttgtgttgccatctcgttgccggagtaagtagacataagacagagtttaagaagtaaaaatatagaaaaattttgatggtcacaatgagataaatattagaatattactattccaatgattaaatgaggatcttgaaataaattctgaagtcttccaatttttacatttattggaggggtccctgagttctgtcaacttttttatttaagtctcttgctcttattttgtgcataaatgttaaaccttccaaaaatgaaatgttagctttctttcttttactttttattaaatttaatagaaaatatgacctgagtagttaaaaagtattttgcattatttgcagtaagatgtctctagcactgctcaaagggcaaattttaaaacttcagtctgggtgaaagatttgctagttttacagaaagatttgctatcttaaactcaagctggtttttctgttctcatgtaagtgactgggatgctgtcttatgaattcttccaaggtcatgtttgtgaaataaacattacatgagagctttcctgtcatctacactatatgttgtctggagtgttgaacaaatttattttagtttctaagttgtaatctatcctcatatggtctatacgattttgaatgtgtgccactacatactgagatgataatgctgtacaattttaagtggtagcagtttctgtatgcagtaggctgaaatattttgatgaactgcttaatttttggattttattttttaagttgtataatttattttcttgcaaaataaaaatgtaatataaaagcttttacctatccagaaaatgttgatgttctactataaaatagttacaaagagtttaattaaaatttttatagtaggtatatttttaaatttgaaggtaaattaatctcagccagccttaggaatcagaaatatgaaaagtaacccacttatttatattagacttcaaattctaattcaaaatgagagcagtcaggaatgtagcttttccactgatgatagcatgtggctatatgcctggaagaggtaat

SEQ ID NO: 285984 - DNA, 2056 bp, Homo sapiens
tcatcatttttttgcagtcaacacatatttactgggcgcattctatgcacgagttattgaagacagctgttgtaagcatttcaggacaatgcacctcccttaacaccgagtccgggatttggggcggggtgccggaaaacgccaggtcccgccagcagagggcacggtcccggcctcgctgcagcctcgggacccaccgaggcttccaggctcccacgctcgctcccgagcgcgtccccgccctcgcgtcacgtgacgtggccgcggaacctgagctgcggggcctaagccgagctaaattcgttgcaggtggccgcggcgggtgcaaccacaaaggctaatccgaaggagtcggggaggctcgtggagtcgatgcttcctcttccaagtcaggtcggctcccgttaccttctcagcattcgccgttccggtcttcctgagcgcgtgcatgaggtctttcgcgtggggaagctccggtgaccatgtaggggacaagagtgaggaagctcctggtgcttgggacgaggtcagcgctgtcggcgcgctgctccagcgcccaccacaccctggtgcgggccgacgggcctgggccctggtgggagctccggcctccggtcaaggcctggccgggagcgccacgaattctcgcgtcgtctcgcgagagtccaagttaaagaacatggcgacgtctaatctgttaaagaataaaggttctcttcagtttgaagacaaatgggattttatgcgcccgattgttttgaagcttttacgccaggaatctgttacaaaacagcagtggtttgatctgttttcggatgtgcatgcagtctgtctttgggatgataaaggcccagcaaaaattcatcaggctttaaaagaagatattcttgagtttattaagcaggcacaggcacgagtactgagccatcaagatgatacggctttgctaaaagcatatattgttgaatggcgaaagttctttacacaatgtgatattttaccaaaacctttttgtcaactagagattactttaatgggtaaacagggcagcaataaaaaatcaaatgtggaagacagtattgttcgaaagcttatgcttgatacatggaatgagtcaatcttttcaaacataaaaaacagactccaagatagtgcaatgaagctggtacatgctgagagattgggagaagcttttgattctcagctggttattggagtaagagaatcctatgttaacctttgttctaatcctgaggataaacttcaaatttatagggacaattttgagaaggcatacttggattcaacagagagattttatagaacacaagcaccctcgtatttacaacaaaatggtgtacagaattatatgaaatatgcagatgctaaattaaaagaagaagaaaaacgagcactacgttatttagaaacaagacgagaatgtaactccgttgaagcactcatggaatgctgtgtaaatgccctggtgacatcatttaaagagactatcttagctgagtgccaaggcatgatcaagagaaatgaaactgaaaaattacatttaatgttttcattgatggacaaagttcctaatggtatagagccaatgttgaaagacttggaggaacatatcattagtgctggcctggcagatatggtagcagctgctgaaactattactactgactctgagaaatacgttgagcagttacttacactatttaatagatttagtaaactcgtcaaagaagcttttcaagatgatccacgatttcttactgcaagagataagacccagctcaaagaatacttcccctggagcttccttgatgtcctgcctccctccacagctcatcaccagcagagttgattcctccatcctccgtcctttcatgggactccttcgggagttatgttatacttatccttgtttcccagggaagcatttgtattgcataccatctttttccatcctcactagtataggataatgataataaaacaccatactgtccttagcattgtatcttttttagtgtaataaacctataacaag

SEQ ID NO: 285985 - DNA, 390 bp, Homo sapiens
ggtcatttgctgcacccatcaacccgtcatctacatgaggtgtttctcctaatgcttatccctcccctatccccccaccccaataagcagattctcttttatggggcatgagaaaacaaaagatgtttttatttgttaagtaaaagatactagtctcaacattaatcccctagtgattattattcatttgggtagatgttggatagaggatgaatatgcataaaaagtcatttttcagtttgttgtacttaaaataatttcgtatattaatgcgcttttatttttattttttcttttaggaagctatcatacaaataatgaaaatgagaaagaaaattagtaatgctcagctgcagactgaattagtagaaattttgaaaaacatgttct

SEQ ID NO: 285986 - DNA, 547 bp, Homo sapiens
ctcttggtacttaagtatgtacagaacaaagatgtttttatgaggtatcataaagctcatttgacacgacgtcttatattagacatctctgccgatagtgaaattgaagaaaacatggtagagtggctaagagtaagtaaatttttttaaatatttggttttctaatacattacatcatttatatgtgtgcttaagtaatacattttggagatattgttaatgtcaaagaagtaggaaacattttataagaatatagcgtcagttaggccgggcgcactggctcatacctgtaatcccagcactttgggaggccgaggcaggtggatcacctgaagtcaggagttcaagactagcctgaccaacatggcaaaaccgcgtctctactaaaaatacaaaaattagctggatgtgctggtgcactccggtaattccagctgcttgggaggctgaggcaagagaatcacttgaacccaggaggtggaggttgcagtgagccaagatcgtgccattgcactccagcctgggtaacagagtgggactccattt

SEQ ID NO: 285987 - DNA, 490 bp, Homo sapiens
tgttatttttcatcagtggagaacaactatattcgttttgtcttggctgtaagcatttgttaaacattagatagccttgtgaattagaatttagttagaaagttgcttttttctcatttttccaagaatgtttttctgtttttgaatattactgatctattgaattcctattcatccttccattaagacccagctcaaagaatacttcccctggagcttccttgatgtcctgcctccctccacagctcatcaccagcagagttgattcctccatcctccgtcctttcatgggactccttcgggagttatgttatacttatccttgtttcccagggaagcatttgtattgcataccatctttttccatcctcactagtataggataatgataataaaacaccatactgtccttagcattgtatcttttttagtgtaataaacctataacaagaaattgctgttagttttttctcttctttgactacctttc

SEQ ID NO: 285988 - DNA, 519 bp, Homo sapiens
ttggaatttagaagaaataattttgtagtaattgtggcccttatgtttaacagataattcagcattggcgtatttgcttgtcccaatacaagaatgccaaaggaggaaacaggaaaaattgccgtccattttaaaaatttaggtttgttgttttaaaccataattgttctcagaacttttttggaacttctaattttgggtcatttaatttaagaatgagagtcatgatgttttgatttatgaaggtgaatttaatgcaaaagtgggtaacactacattcatagcaaagttttttattaaattttataaatttttaatagccaattatgtcctaattgtattttggggaatgaacagcagcaaatactgtaaatgtacagttttctttttttttttttttggttatgtatacaaaagttttaactactttttggtgtttatgaaaatcatttagttgacaaggtgcctatgccattgttaaattttctttaagtaatttaacaacagatttgctaattt

SEQ ID NO: 285989 - DNA, 508 bp, Homo sapiens
agagagaacgacaggtttgccttctactcattcttaaaactaaacacttcaaactaaaaatgcagaactaacccactgacccctgttgctaatggtgctatgtggcccttcctgccgacaagctcgcagcccctgatgggggctgtgtagcccttcagcctgagtaggggttgtgagcccagccccgtcccggaatgccacggtcatctggtgctctaccactgggcagagggagggcaggactgcctttcggggtcctgaacccaccttccgggttcaagatattcttgtgcatcagcctcccaagtagctgggattacaggcacctgccaccacgcctgactaatttttgtatttttagtagagacggggtttcaccatgttagccaggctgtcctcaaaggtgatctgcccgccttggcctcacaaagtgctgggattacaggcgtgagccactgcgcccggccctcgcttccaaagatttttcattgttgttcccagaagaggc

SEQ ID NO: 285990 - DNA, 563 bp, Homo sapiens
tcctggctggtgaacaggcctgaaggcagaatccctacacaatgaagaagtctgtaaacgatgttttcctgtgtctaataaactctagtgacctttatccattgagataaggctcaagagaacaatgtgagatggcagagtggtctcagagtgggattttcagaactctaaatattcttctaagttaactttcttacttttcttccattaaagaaggaaactggtcttcagtttgattttttcactctcaggtctccaacatatcccattgaccagagtaagtataattttctttttagatttcagcattcaattttggaaccatcagcaaaagatctcagattctgagaaggaacaaatgatctggtcctggcctggagaattgggcccctgggagcatggggtcttcctcgcagttgctctatgggaatgaaaaagccactgatgcttcattgaaggctgggccccagactggcaccttggtttaatgactacagatcctcctgcttgatgaatgtgtgcatctcaaaggccagaggcagacgtgcatctaaagacaggtg

SEQ ID NO: 285991 - DNA, 1058 bp, Homo sapiens
gacatgtttttccatttgtttgtgtcttctctgatttctttgagcagtgttttgtaattcttctagagatctcctagagatctttcacctccctggttagctgtattcctaggtatcttattttttctgtgtgtagcaattatgaatgggattgtgttcttcatttgactctctgcttgacttgatgtataggactgctagtaatttttgcacattgattttgtatgctaagactttgctaaagtttatcagcagaagaagctttggggccaagactatggggctttctagatatagaaacatgtcatctgtaaacagagacagtttgacttcctgtctattcctctcttccctcctctgtttggatgcccttccagttttgcacattcagtgtaatgttggctgtgggtttgtcatggctagctctcatcattttggcacttctgactagaagggcaagaggggccagtgttgttgttacctgaaaggtaagtgcagcccacaaaaatgcagtgaagaagaagatgtattatgcatatgtttaagttaatacaattgagatatatttagcagacagaatcaatagagttgatgagtgactgactggatgtgtggggagtttatatcactcccaggtttttgacttgggcaaccgggcactcatgaaggaaaaaggggatccagggagaggaacttttctgaggactggggtagggctgaacagctgcattcgaggctggtggagggtgggctgggcatgggatgcacaaatggaaattccactgggtctgcagctcacacataggcatgaccagcatagagatagagaggccccagtgctgctgagtaactgtgattccccaggtgatggcatcagctgagaagggaaggaagcccatgagaggacactgaagaaggagtgagcagacaataagaagcccacagaagacagagaaggaacaactagagggagaagccaaggcaggcgtgtgtggtaacacataggaactgagggagaggacatttcaagatggtggccctgaggattgcttggctgg

SEQ ID NO: 285992 - DNA, 521 bp, Homo sapiens
ccttcttccctccattcttctgtttttaatggggatgtttaaaatccaatctcacattaattttttcttaagtgtaaataatgggaaaacttcacttcgagaggggactcctcagtagacctccataatttcctggcttttactgccagttagtcatcaggaatagccacggctaagagagtaccaactgggcaagccagtgaattataccagtgcatctcagatttactgatttgtttaacttttgttttttgttctttttttttttcagagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaatacaaaatttattgaatatactttttcaaacaaagtttcatgttctaatcattgtctgatttcagcattaaatgaaacacagtaaagaaagttgggctg

SEQ ID NO: 285993 - DNA, 499 bp, Homo sapiens
tgtttctctcctgtcactttgctcctatttctttcatgtgaaagaatgttcattttctttgaaaatgagctcatttcctcattttctttccatatttcagcaggaacaaagatcaccacaactggctcgccttcaactatgttagatggcaacttgccttcagtatggtgaaacacatcagttaagaccggggttgtgcatggcaggactttctacaaggacacccagtctccttaataaacatgagatgctctctttccagaatttctcttgcctgacacagcataggaagatgctgaacggccacacagtgatccattggtcagtggtgacataaggaggtcagaggggaggagtgaggagaagtagggaagactaggtggttgtaggcctccttcatctgttcattggctgtggcattaggccagctactctttgcacttctgtaaagtgagacggtcgatcttgtctgcctctctagaggatggttgcaggtgtc

SEQ ID NO: 285994 - DNA, 1986 bp, Homo sapiens
gacatgtttttccatttgtttgtgtcttctctgatttctttgagcagtgttttgtaattcttctagagatctcctagagatctttcacctccctggttagctgtattcctaggtatcttattttttctgtgtgtagcaattatgaatgggattgtgttcttcatttgactctctgcttgacttgatgtataggactgctagtaatttttgcacattgattttgtatgctaagactttgctaaagtttatcagcagaagaagctttggggccaagactatggggctttctagatatagaaacatgtcatctgtaaacagagacagtttgacttcctgtctattcctctcttccctcctctgtttggatgcccttccagttttgcacattcagtgtaatgttggctgtgggtttgtcatggctagctctcatcattttggcacttctgactagaagggcaagaggggccagtgttgttgttacctgaaaggtaagtgcagcccacaaaaatgcagtgaagaagaagatgtattatgcatatgtttaagttaatacaattgagatatatttagcagacagaatcaatagagttgatgagtgactgactggatgtgtggggagtttatatcactcccaggtttttgacttgggcaaccgggcactcatgaaggaaaaaggggatccagggagaggaacttttctgaggactggggtagggctgaacagctgcattcgaggctggtggagggtgggctgggcatgggatgcacaaatggaaattccactgggtctgcagctcacacataggcatgaccagcatagagatagagaggccccagtgctgctgagtaactgtgattccccaggtgatggcatcagctgagaagggaaggaagcccatgagaggacactgaagaaggagtgagcagacaataagaagcccacagaagacagagaaggaacaactagagggagaagccaaggcaggcgtgtgtggtaacacataggaactgagggagaggacatttcaagatggtggggatgccatacaacaggactatgtgatggtttttggctgtgtccataggaagtcacaacaggcaagggaaagaaaccagaacccagtcatggagctaagaagtgagtcagagagtagaggggtagggacagtgaggtaagtcctctttctaaggaagtttggctgaaggatagactagctggacacatgctggctgtgtggggtagagggaggaatgatggagggtaggagagccttgagcctgcgagaagagtctcttagaatagagaagctgaagttaaagttgtggaagagagtggggataactgagtgacagataatcaggagaagaaaaggagatccagactcatgacagagagatgacctttgccaagagcacagccgtctttcacggtcacagagaggtaggacaaaatgagtggtgttcaagaattggtttgtagcacaatatttcaactatgtcctttaaaaagtttctccacagacactacccaaagcagtgcttcactacagtggcagacagacctgaaaattttcatctgaagcagcagagtgaactgcagaggcaggtcaccaaccagtgtggaggctaaaagcgggcctctttggggattccaggtggaagtgttggacatctgtagtattcctggtctcgaatcatcctgatattcttcattttgttattcacattggactaggagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaatacaaaatttattgaatatactttttcaaacaaagtttcatgttctaatcattgtctgatttcagcattaaatgaaacacagtaaagaaagttgggctg

SEQ ID NO: 285995 - DNA, 2207 bp, Homo sapiens
gacatgtttttccatttgtttgtgtcttctctgatttctttgagcagtgttttgtaattcttctagagatctcctagagatctttcacctccctggttagctgtattcctaggtatcttattttttctgtgtgtagcaattatgaatgggattgtgttcttcatttgactctctgcttgacttgatgtataggactgctagtaatttttgcacattgattttgtatgctaagactttgctaaagtttatcagcagaagaagctttggggccaagactatggggctttctagatatagaaacatgtcatctgtaaacagagacagtttgacttcctgtctattcctctcttccctcctctgtttggatgcccttccagttttgcacattcagtgtaatgttggctgtgggtttgtcatggctagctctcatcattttggcacttctgactagaagggcaagaggggccagtgttgttgttacctgaaaggtaagtgcagcccacaaaaatgcagtgaagaagaagatgtattatgcatatgtttaagttaatacaattgagatatatttagcagacagaatcaatagagttgatgagtgactgactggatgtgtggggagtttatatcactcccaggtttttgacttgggcaaccgggcactcatgaaggaaaaaggggatccagggagaggaacttttctgaggactggggtagggctgaacagctgcattcgaggctggtggagggtgggctgggcatgggatgcacaaatggaaattccactgggtctgcagctcacacataggcatgaccagcatagagatagagaggccccagtgctgctgagtaactgtgattccccaggtgatggcatcagctgagaagggaaggaagcccatgagaggacactgaagaaggagtgagcagacaataagaagcccacagaagacagagaaggaacaactagagggagaagccaaggcaggcgtgtgtggtaacacataggaactgagggagaggacatttcaagatggtggggatgccatacaacaggactatgtgatggtttttggctgtgtccataggaagtcacaacaggcaagggaaagaaaccagaacccagtcatggagctaagaagtgagtcagagagtagaggggtagggacagtgaggtaagtcctctttctaaggaagtttggctgaaggatagactagctggacacatgctggctgtgtggggtagagggaggaatgatggagggtaggagagccttgagcctgcgagaagagtctcttagaatagagaagctgaagttaaagttgtggaagagagtggggataactgagtgacagataatcaggagaagaaaaggagatccagactcatgacagagagatgacctttgccaagagcacagccgtctttcacggtcacagagaggtaggacaaaatgagtggtgttcaagaattggtttgtagcacaatatttcaactatgtcctttaaaaagtttctccacagacactacccaaagcagtgcttcactacagtggcagacagacctgaaaattttcatctgaagcagcagagtgaactgcagaggcaggtcaccaaccagtgtggaggctaaaagcgggcctctttggggattccaggtggaagtgttggacatctgtagtattcctggtctcgaatcatcctgatattcttcattttgttattcacattggactaggcaggaacaaagatcaccacaactggctcgccttcaactatgttagatggcaacttgccttcagtatggtgaaacacatcagttaagaccggggttgtgcatggcaggactttctacaaggacacccagtctccttaataaacatgagatgctctctttccagaatttctcttgcctgacacagcataggaagatgctgaacggccacacagtgatccattgagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaatacaaaatttattgaatatactttttcaaacaaagtttcatgttctaatcattgtctgatttcagcattaaatgaaacacagtaaagaaagttgggctg

SEQ ID NO: 285996 - DNA, 904 bp, Homo sapiens
ggcacccattcaacatctcatttcttagctccagaacccagtcatggagctaagaagtgagtcagagagtagaggggtagggacagtgaggtaagtcctctttctaaggaagtttggctgaaggatagactagctggacacatgctggctgtgtggggtagagggaggaatgatggagggtaggagagccttgagcctgcgagaagagtctcttagaatagagaagctgaagttaaagttgtggaagagagtggggataactgagtgacagataatcaggagaagaaaaggagatccagactcatgacagagagatgacctttgccaagagcacagccgtctttcacggtcacagagaggtaggacaaaatgagtggtgttcaagaattggtttgtagcacaatatttcaactatgtcctttaaaaagtttctccacagacactacccaaagcagtgcttcactacagtggcagacagacctgaaaattttcatctgaagcagcagagtgaactgcagaggcaggtcaccaaccagtgtggaggctaaaagcgggcctctttggggattccaggtggaagtgttggacatctgtagtattcctggtctcgaatcatcctgatattcttcattttgttattcacattggactaggagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaatacaaaatttattgaatatactttttcaaacaaagtttcatgttctaatcattgtctgatttcagcattaaatgaaacacagtaaagaaagttgggctg

SEQ ID NO: 285997 - DNA, 2231 bp, Homo sapiens
  misc_feature (2210)..(2211): n is a, c, g, or t
gacatgtttttccatttgtttgtgtcttctctgatttctttgagcagtgttttgtaattcttctagagatctcctagagatctttcacctccctggttagctgtattcctaggtatcttattttttctgtgtgtagcaattatgaatgggattgtgttcttcatttgactctctgcttgacttgatgtataggactgctagtaatttttgcacattgattttgtatgctaagactttgctaaagtttatcagcagaagaagctttggggccaagactatggggctttctagatatagaaacatgtcatctgtaaacagagacagtttgacttcctgtctattcctctcttccctcctctgtttggatgcccttccagttttgcacattcagtgtaatgttggctgtgggtttgtcatggctagctctcatcattttggcacttctgactagaagggcaagaggggccagtgttgttgttacctgaaaggtaagtgcagcccacaaaaatgcagtgaagaagaagatgtattatgcatatgtttaagttaatacaattgagatatatttagcagacagaatcaatagagttgatgagtgactgactggatgtgtggggagtttatatcactcccaggtttttgacttgggcaaccgggcactcatgaaggaaaaaggggatccagggagaggaacttttctgaggactggggtagggctgaacagctgcattcgaggctggtggagggtgggctgggcatgggatgcacaaatggaaattccactgggtctgcagctcacacataggcatgaccagcatagagatagagaggccccagtgctgctgagtaactgtgattccccaggtgatggcatcagctgagaagggaaggaagcccatgagaggacactgaagaaggagtgagcagacaataagaagcccacagaagacagagaaggaacaactagagggagaagccaaggcaggcgtgtgtggtaacacataggaactgagggagaggacatttcaagatggtggggatgccatacaacaggactatgtgatggtttttggctgtgtccataggaagtcacaacaggcaagggaaagaaaccagaacccagtcatggagctaagaagtgagtcagagagtagaggggtagggacagtgaggtaagtcctctttctaaggaagtttggctgaaggatagactagctggacacatgctggctgtgtggggtagagggaggaatgatggagggtaggagagccttgagcctgcgagaagagtctcttagaatagagaagctgaagttaaagttgtggaagagagtggggataactgagtgacagataatcaggagaagaaaaggagatccagactcatgacagagagatgacctttgccaagagcacagccgtctttcacggtcacagagaggtaggacaaaatgagtggtgttcaagaattggtttgtagcacaatatttcaactatgtcctttaaaaagtttctccacagacactacccaaagcagtgcttcactacagtggcagacagacctgaaaattttcatctgaagcagcagagtgaactgcagaggcaggtcaccaaccagtgtggaggctaaaagcgggcctctttggggattccaggtggaagtgttggacatctgtagtattcctggtctcgaatcatcctgatattcttcattttgttattcacattggactaggcaggaacaaagatcaccacaactggctcgccttcaactatgttagatggcaacttgccttcagtatggtgaaacacatcagttaagaccggggttgtgcatggcaggactttctacaaggacacccagtctccttaataaacatgagatgctctctttccagaatttctcttgcctgacacagcataggaagatgctgaacggccacacagtgatccattgagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaatacaaaatttattgaatatactttttcaaacaaagtttcatgttctaatcattgtctgatttcagcattaaatgaaacacagtaaagaaagttgggctggtnnaaaaaaaaaaagtattaatc

SEQ ID NO: 285998 - DNA, 2078 bp, Homo sapiens
gacatgtttttccatttgtttgtgtcttctctgatttctttgagcagtgttttgtaattcttctagagatctcctagagatctttcacctccctggttagctgtattcctaggtatcttattttttctgtgtgtagcaattatgaatgggattgtgttcttcatttgactctctgcttgacttgatgtataggactgctagtaatttttgcacattgattttgtatgctaagactttgctaaagtttatcagcagaagaagctttggggccaagactatggggctttctagatatagaaacatgtcatctgtaaacagagacagtttgacttcctgtctattcctctcttccctcctctgtttggatgcccttccagttttgcacattcagtgtaatgttggctgtgggtttgtcatggctagctctcatcattttggcacttctgactagaagggcaagaggggccagtgttgttgttacctgaaaggtaagtgcagcccacaaaaatgcagtgaagaagaagatgtattatgcatatgtttaagttaatacaattgagatatatttagcagacagaatcaatagagttgatgagtgactgactggatgtgtggggagtttatatcactcccaggtttttgacttgggcaaccgggcactcatgaaggaaaaaggggatccagggagaggaacttttctgaggactggggtagggctgaacagctgcattcgaggctggtggagggtgggctgggcatgggatgcacaaatggaaattccactgggtctgcagctcacacataggcatgaccagcatagagatagagaggccccagtgctgctgagtaactgtgattccccaggtgatggcatcagctgagaagggaaggaagcccatgagaggacactgaagaaggagtgagcagacaataagaagcccacagaagacagagaaggaacaactagagggagaagccaaggcaggcgtgtgtggtaacacataggaactgagggagaggacatttcaagatggtggggatgccatacaacaggactatgtgatggtttttggctgtgtccataggaagtcacaacaggcaagggaaagaaaccagaacccagtcatggagctaagaagtgagtcagagagtagaggggtagggacagtgaggtaagtcctctttctaaggaagtttggctgaaggatagactagctggacacatgctggctgtgtggggtagagggaggaatgatggagggtaggagagccttgagcctgcgagaagagtctcttagaatagagaagctgaagttaaagttgtggaagagagtggggataactgagtgacagataatcaggagaagaaaaggagatccagactcatgacagagagatgacctttgccaagagcacagccgtctttcacggtcacagagaggtaggacaaaatgagtggtgttcaagaattggtttgtagcacaatatttcaactatgtcctttaaaaagtttctccacagacactacccaaagcagtgcttcactacagtggcagacagacctgaaaattttcatctgaagcagcagagtgaactgcagaggcaggtcaccaaccagtgtggaggctaaaagcgggcctctttggggattccaggtggaagtgttggacatctgtagtattcctggtctcgaatcatcctgatattcttcattttgttattcacattggactaggagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaatacaaaatttattgaatatactttttcaaacaaagtttcatgttctaatcattgtctgatttcagcattaaatgaaacacagtaaagaaagttgggctgatgttgttgttggtggttgtttttgtattctgattacagaactgtattttgagtgggctgaacatagagtaaatgcatcctcagctgctggt

SEQ ID NO: 285999 - DNA, 2135 bp, Homo sapiens
gacatgtttttccatttgtttgtgtcttctctgatttctttgagcagtgttttgtaattcttctagagatctcctagagatctttcacctccctggttagctgtattcctaggtatcttattttttctgtgtgtagcaattatgaatgggattgtgttcttcatttgactctctgcttgacttgatgtataggactgctagtaatttttgcacattgattttgtatgctaagactttgctaaagtttatcagcagaagaagctttggggccaagactatggggctttctagatatagaaacatgtcatctgtaaacagagacagtttgacttcctgtctattcctctcttccctcctctgtttggatgcccttccagttttgcacattcagtgtaatgttggctgtgggtttgtcatggctagctctcatcattttggcacttctgactagaagggcaagaggggccagtgttgttgttacctgaaaggtaagtgcagcccacaaaaatgcagtgaagaagaagatgtattatgcatatgtttaagttaatacaattgagatatatttagcagacagaatcaatagagttgatgagtgactgactggatgtgtggggagtttatatcactcccaggtttttgacttgggcaaccgggcactcatgaaggaaaaaggggatccagggagaggaacttttctgaggactggggtagggctgaacagctgcattcgaggctggtggagggtgggctgggcatgggatgcacaaatggaaattccactgggtctgcagctcacacataggcatgaccagcatagagatagagaggccccagtgctgctgagtaactgtgattccccaggtgatggcatcagctgagaagggaaggaagcccatgagaggacactgaagaaggagtgagcagacaataagaagcccacagaagacagagaaggaacaactagagggagaagccaaggcaggcgtgtgtggtaacacataggaactgagggagaggacatttcaagatggtggggatgccatacaacaggactatgtgatggtttttggctgtgtccataggaagtcacaacaggcaagggaaagaaaccagaacccagtcatggagctaagaagtgagtcagagagtagaggggtagggacagtgaggtaagtcctctttctaaggaagtttggctgaaggatagactagctggacacatgctggctgtgtggggtagagggaggaatgatggagggtaggagagccttgagcctgcgagaagagtctcttagaatagagaagctgaagttaaagttgtggaagagagtggggataactgagtgacagataatcaggagaagaaaaggagatccagactcatgacagagagatgacctttgccaagagcacagccgtctttcacggtcacagagaggtaggacaaaatgagtggtgttcaagaattggtttgtagcacaatatttcaactatgtcctttaaaaagtttctccacagacactacccaaagcagtgcttcactacagtggcagacagacctgaaaattttcatctgaagcagcagagtgaactgcagaggcaggtcaccaaccagtgtggaggctaaaagcgggcctctttggggattccaggtggaagtgttggacatctgtagtattcctggtctcgaatcatcctgatattcttcattttgttattcacattggactaggcaggaacaaagatcaccacaactggctcgccttcaactatgttagatggcaacttgccttcagtatggtgaaacacatcagttaagaccggggttgtgcatggcaggactttctacaaggacacccagtctccttaataaacatgagatgctctctttccagaatttctcttgcctgacacagcataggaagatgctgaacggccacacagtgatccattggtcagtggtgacataaggaggtcagaggggaggagtgaggagaagtagggaagactaggtggttgtaggcctccttcatctgttcattggctgtggcattaggccagctactctttgcacttctgtaaagtgagacggtcgatcttgtctgcctctctagaggatggttgcaggtgtc

SEQ ID NO: 286000 - DNA, 1691 bp, Homo sapiens
gacatgtttttccatttgtttgtgtcttctctgatttctttgagcagtgttttgtaattcttctagagatctcctagagatctttcacctccctggttagctgtattcctaggtatcttattttttctgtgtgtagcaattatgaatgggattgtgttcttcatttgactctctgcttgacttgatgtataggactgctagtaatttttgcacattgattttgtatgctaagactttgctaaagtttatcagcagaagaagctttggggccaagactatggggctttctagatatagaaacatgtcatctgtaaacagagacagtttgacttcctgtctattcctctcttccctcctctgtttggatgcccttccagttttgcacattcagtgtaatgttggctgtgggtttgtcatggctagctctcatcattttggcacttctgactagaagggcaagaggggccagtgttgttgttacctgaaaggtaagtgcagcccacaaaaatgcagtgaagaagaagatgtattatgcatatgtttaagttaatacaattgagatatatttagcagacagaatcaatagagttgatgagtgactgactggatgtgtggggagtttatatcactcccaggtttttgacttgggcaaccgggcactcatgaaggaaaaaggggatccagggagaggaacttttctgaggactggggtagggctgaacagctgcattcgaggctggtggagggtgggctgggcatgggatgcacaaatggaaattccactgggtctgcagctcacacataggcatgaccagcatagagatagagaggccccagtgctgctgagtaactgtgattccccaggtgatggcatcagctgagaagggaaggaagcccatgagaggacactgaagaaggagtgagcagacaataagaagcccacagaagacagagaaggaacaactagagggagaagccaaggcaggcgtgtgtgtttctccacagacactacccaaagcagtgcttcactacagtggcagacagacctgaaaattttcatctgaagcagcagagtgaactgcagaggcaggtcaccaaccagtgtggaggctaaaagcgggcctctttggggattccaggtggaagtgttggacatctgtagtattcctggtctcgaatcatcctgatattcttcattttgttattcacattggactaggcaggaacaaagatcaccacaactggctcgccttcaactatgttagatggcaacttgccttcagtatggtgaaacacatcagttaagaccggggttgtgcatggcaggactttctacaaggacacccagtctccttaataaacatgagatgctctctttccagaatttctcttgcctgacacagcataggaagatgctgaacggccacacagtgatccattgagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaatacaaaatttattgaatatactttttcaaacaaagtttcatgttctaatcattgtctgatttcagcattaaatgaaacacagtaaagaaagttgggctg

SEQ ID NO: 286001 - DNA, 1909 bp, Homo sapiens
gacatgtttttccatttgtttgtgtcttctctgatttctttgagcagtgttttgtaattcttctagagatctcctagagatctttcacctccctggttagctgtattcctaggtatcttattttttctgtgtgtagcaattatgaatgggattgtgttcttcatttgactctctgcttgacttgatgtataggactgctagtaatttttgcacattgattttgtatgctaagactttgctaaagtttatcagcagaagaagctttggggccaagactatggggctttctagatatagaaacatgtcatctgtaaacagagacagtttgacttcctgtctattcctctcttccctcctctgtttggatgcccttccagttttgcacattcagtgtaatgttggctgtgggtttgtcatggctagctctcatcattttggcacttctgactagaagggcaagaggggccagtgttgttgttacctgaaaggtaagtgcagcccacaaaaatgcagtgaagaagaagatgtattatgcatatgtttaagttaatacaattgagatatatttagcagacagaatcaatagagttgatgagtgactgactggatgtgtggggagtttatatcactcccaggtttttgacttgggcaaccgggcactcatgaaggaaaaaggggatccagggagaggaacttttctgaggactggggtagggctgaacagctgcattcgaggctggtggagggtgggctgggcatgggatgcacaaatggaaattccactgggtctgcagctcacacataggcatgaccagcatagagatagagaggccccagtgctgctgagtaactgtgattccccaggtgatggcatcagctgagaagggaaggaagcccatgagaggacactgaagaaggagtgagcagacaataagaagcccacagaagacagagaaggaacaactagagggagaagccaaggcaggcgtgtgtggtaacacataggaactgagggagaggacatttcaagatggtggggatgccatacaacaggactatgtgatggtttttggctgtgtccataggaagtcacaacaggcaagggaaagaaaccagaacccagtcatggagctaagaagtgagtcagagagtagaggggtagggacagtgaggtaagtcctctttctaaggaagtttggctgaaggatagactagctggacacatgctggctgtgtggggtagagggaggaatgatggagggtaggagagccttgagcctgcgagaagagtctcttagaatagagaagctgaagttaaagttgtggaagagagtggggataactgagtgacagataatcaggagaagaaaaggagatccagactcatgacagagagatgacctttgccaagagcacagccgtctttcacggtcacagagaggtaggacaaaatgagtggtgttcaagaattggtttgtagcacaatatttcaactatgtcctttaaaaagtttctccacagacactacccaaagcagtgcttcactacagtggcagacagacctgaaaattttcatctgaagcagcagagtgaactgcagaggcaggtcaccaaccagtgtggaggctaaaagcgggcctctttggggattccaggtggaagtgttggacatctgtagtattcctggtctcgaatcatcctgatattcttcattttgttattcacattggactagggtgaggaaatgagttctggtcagagtcaatgtttcctaacaatgttgatttatttggtcctaaatatttaaacacattttataaatagcttttccacaccacatatatagggaaaaacagggagttaacttggcccagcagcactgtttgtggggctaacaccctgtctgtgt

SEQ ID NO: 286002 - DNA, 980 bp, Homo sapiens
caaggtggctggccggcaggccaatggcggccaacgccacttccggccgccctccgagcatcgctcttcggcaacccgaagccacaggatggaggagggggatcccagcaaagatcccagtttctgacctgcagcatagtccctctctctgaagaacttcctgtaatattttttgctaggaagagtttgaagtttgaaatcccagaatgaggaaattcatccagcttggagacttccaatcccttcattgtgcagaaggttgctaatgctctcaggagaagcccttcaccaagagaatacttccacatagagtcctctccattgagactaaggaaacatgctatgtcatgtagccacagcagcctttgcagctgttgaaggcagcaagacttgcatggcaatcagaagacacagaaccaagactcatatccagttataagatggcagatgggacacacactcatcaggcttagtgagcagccaatccagagggaaccatactcagccctaggggctgggcgcggtggctctcgcctgtaatcccagcactttgggaggccaaggcggatggatcacctgaggtcacgagttcaagaccagcctgaccaacatggagaaatcccatctctactaaaaatacaaaattagctgggcatggtggtgcatgcctgtagtcccagttactcgggaggctgaggcaggagaatcactcgaacccgagaggcagaggttgtggtgagctgagattgtgccattgcactccagtctgggcaacaagagtgaaactctgtctcaaaaaaaaaaaaaaaaaaaaaaagccctaggaagatttcttcaaacagatgaagctaatgatatccccagtgtgtttgaatatattgagagatcacacaatagggacactgtttagggttgaattaatagcaagcaaatgggatgctaaggaaatataaagaataaaagttcaaagggaaaacaaa

SEQ ID NO: 286003 - DNA, 647 bp, Homo sapiens
caaggtggctggccggcaggccaatggcggccaacgccacttccggccgccctccgagcatcgctcttcggcaacccgaagccacaggatggaggagggggatcccagcaaagatcccagtttctgacctgcagcatagtccctctctctgaagaacttcctgtaatattttttgctaggaagagtttgaagtttgaaatcccagaatgaggaaattcatccagcttggagacttccaatcccttcattgtgcagaaggttgctaatgctctcaggagaagcccttcaccaagagaatacttccacatagagtcctctccattgagactaaggaaacatgctatgtcatgtagccacagcagcctttgcagctgttgaaggcagcaagacttgcatggcaatcagaagacacagaaccaagactcatatccatctgggcaacaagagtgaaactctgtctcaaaaaaaaaaaaaaaaaaaaaaagccctaggaagatttcttcaaacagatgaagctaatgatatccccagtgtgtttgaatatattgagagatcacacaatagggacactgtttagggttgaattaatagcaagcaaatgggatgctaaggaaatataaagaataaaagttcaaagggaaaacaaa

SEQ ID NO: 286004 - DNA, 397 bp, Homo sapiens
cctctacaaggatgtgatgatggggacctatgggaacctactctcattaggacttcaagcttccaaacctgatgtcatctccaggctggagcggggggacgaaccatagacccctcacatcctgagaactcaggggagctggagctggaggcacaagagagaagagacggggtttcaccgtgttagccaggatggtctctatctcctgacctcgtgatccgcccgcctcgacctcctgaagtgctgggattgcaggcatgaagcaccgcaccaggccttttatattcttttgaataaatcaaactttatgtaattttatttttcttctccattagctttttagttgtacattcttttttaagtgatgactctaatgattaaatatgtctcttcaact

SEQ ID NO: 286005 - DNA, 2847 bp, Homo sapiens
  misc_feature (953)..(953): n is a, c, g, or t
ctcgcaagacctggttgtttaaaagtgggcggcaccttccccttcgctcttcctcctgctcctgccctgatgtgtctggatggtgacagatgggaatcttctccagtgaccagaatccatgccttaccttgggagcccaagctgacttctcaagctctggggatgcctcagtgatctctgatgtggaattagtggaggctggccgttgctcacctctacacagcctgctggtcgttagcgagcaggagttctgatgttcctctcatcttggatgtctttcctaggagaatatttctcacgtgtttgacagaaaacattatctgtccatcatttccatggattcctgggtctcacgggcagaaggacaaggcagatatgaggcggatctggtaaaaccataaacaccatgagatcagagcatccatctgtagactcacagagcaagaagcgtgactgccccaatcttgaatggatgagtaagatgaaaatcaatttataaacatcttgtgacaagctggaattcagttatagatcaattacagattgctcactggacaatcaaggacattattagaaaacggtttccaccactagaaattcatctacattgacatccacctaaatatccagaaggtcatccccactttcgtcgctctccacagtcagctgccgggtccaccacttcttaacttcagaaccgcaggaagccgcgtcagtcatggggttcattttgcacacgacagatttcatggttgtccttcctccaaaccgaggaacctagatcttctctgatctctgaaaaataagttcctggatatgaaaggggatactttccttggtggtagtcccagtgaagacccactgaacatcgtcagcctcaaaatgtaagctgtgctgtcatctgctttgtggaacacatatgctacacatcttctcctttcaattgggctgangttggggcacagttaaagagcattataaagctcctgctttagcatgaacttagttatctatagaaaaaaacatgtacaaggacactgggctgtggggagcattgctctccctccattcctgagtgctcttaatgggattatcctggctttccaaaaccctatagagaagaagctcatagaagaaaattctcttactgaatcagtaaaatatggaaaataatgggactgtttattaaaggattgaatgagagaacacaagtaatgcacttagaagagtgactggcatacagtgagtactacgtgctggcttctcaaccatgatagcctgaaatgtacccggaaaatgggggctaatgtaagtcatatttagagaagttattttgggggacaatgtttttgacaagactacatttttcattatgttgctgtctgtaaacaactgtagatgcagacttgcattttgaaaggcaagacccaaaacacacaaacagagtaaatacctttaaaatgcctcgatcgctggagaaatgcctggatggacctacctgagggcagacgccactgcccaaatttcctctggggtttccctgcgtcggctgcatcttgccgacttcctcctcgatccgacagcgtggggctcaggagctgctgctggctgcttgtctgcatgggaggagaagcacacagttaccgtctttttaaccctgcgctctcctccttttactataagaaaggaaaacacatggcaggaggacaagtgggaagaacaacatggactcagagtgtccacaatggggaaaagtgaaaatgggtataaagggtcacagaagaaaaagagccaccactgcacgccctgctgaaggagacaccactcttcctgggacatcttgtcctgggtaacccccactgcttcgttcccctccatgcctgagaatgtcattgtttcccttcatatcttcgctggcaaaccagggggtaaggaaggggaactgcaggaaggaaggtggggcagtggggacgggctgggcgggggcagtctactgtcaccagcctggagatccacacttagagcttcagggaaagagttctctgcaggcaaagctgtatgatgggccctggtggaggatggagctgataacaatctaagctacagtgaaagaaagagagatgccaagacttcccacacatttcacctgttctcaggttcacctgtcacctctccctttcctaacaaaagccttggtcttcacatctctttagtatccttttttttttttttttgtcacctctttctttcttaggctttttcatctaaaaacagagggctctgaaatcatcactttccccaacctcattagccctgtctcactgtctgtcctgacttcagcctgcctccctctcccatgcgagacattgccaaccatcttcagggtgaccagtggcaaggccactgcagatgcctccccttgccccttggttgactaactccgcagaagtccctgcagtcggtggcagatgatttctaaaggctggggagcccaaaacatgagatctactgaaaactgagctatggcaccagtgggcctcctggagcaccctgctgggccgtggagccttaggcttccaaaggtactctggcccctggctgcgttgctgcacaccatggagcctggtgctgctgggggctctgcacagagcacgggatcagctccacgttgttaacctcaaatcgtaattgctgcctcataaaggggcaggtcctcccagccagctgcttctcacagcacaggactctccaggacgctgataactccttgtacttttttatatagacacatacatagagtttgaaaatgaaaatatgctgtgacttaataaatagaaactcctcaaa

SEQ ID NO: 286006 - DNA, 732 bp, Homo sapiens
gctctgagcaggccgacagtcatagacgagtagaccttaggcgagggaaggcatgtactttccctaagaagcgggaggagagaaataaatagagggcagtgggatgagaagaacctcgcgggatgggaagccgcggagggaagggccgtctttggttacctggagagcgggagcagctgcggatcccttatgaagtgcccggatgaagctccagcgctcacgcgctttccgcattgagtgcagcgccatcttgagaagggcggagccgtcttgtttggaatgacgtctgttcagagagccaatcccagtctcgcgactcctgcttgctgggcgcggcttgggcctccaggctgcgcagcgcagccgctatcgggcggactgcagttcttgccgagcagtcgcaatgatttgtatgacagctgctagcccaagagagagttccagaagagggctacctaacaggtgctgtggcatttagaagaggaatggagccattgtcaacgcacagcttgcaggggagcaggagagtcagtctaagaaggaaatgtgatgatggaaacagaggttggaagatggaagaggacccagagtcaaggaatgcagatggagtcttgctctgctgcccaggctggagtgcagtggactgatcttggctcactgcagcgtccatcttccgggttcaagcgattctcctgcttcagcctctcaagtagctgggattacaggcgccca

SEQ ID NO: 286007 - DNA, 935 bp, Homo sapiens
gctctgagcaggccgacagtcatagacgagtagaccttaggcgagggaaggcatgtactttccctaagaagcgggaggagagaaataaatagagggcagtgggatgagaagaacctcgcgggatgggaagccgcggagggaagggccgtctttggttacctggagagcgggagcagctgcggatcccttatgaagtgcccggatgaagctccagcgctcacgcgctttccgcattgagtgcagcgccatcttgagaagggcggagccgtcttgtttggaatgacgtctgttcagagagccaatcccagtctcgcgactcctgcttgctgggcgcggcttgggcctccaggctgcgcagcgcagccgctatcgggcggactgcagttcttgccgagcaggggagcaggagagtcagtctaagaaggaaatgtgatgatggaaacagaggttggaagatggaagaggacccagagtcaaggaatgcaggtagaaaagaaaagcctggattctcccctaaagcctccagatggaacacagccctgcctccaccttgatttcaggacttcttaccccaagaatctcacccgggaggaaccatctatcatcctgccttgaaggtagtttctgctggatctggtcagacctttgtatgatggattttggaaacccagtggaaggatgttcgctcattgcccccatttgccactataggactatgcgcctcccttttatttactcaatttgcttttatcctgatctattatgttgttgtagacccagttccagttgttacaatactgggttatcagttctaaggccctgggcaagggtggtgtggaacaggtcccacataactgcccatgtcgagagctctaagcctaaattgggagggacaccagggacaagactcctgggttcatagcctaggggcctaa

SEQ ID NO: 286008 - DNA, 1163 bp, Homo sapiens
gctctgagcaggccgacagtcatagacgagtagaccttaggcgagggaaggcatgtactttccctaagaagcgggaggagagaaataaatagagggcagtgggatgagaagaacctcgcgggatgggaagccgcggagggaagggccgtctttggttacctggagagcgggagcagctgcggatcccttatgaagtgcccggatgaagctccagcgctcacgcgctttccgcattgagtgcagcgccatcttgagaagggcggagccgtcttgtttggaatgacgtctgttcagagagccaatcccagtctcgcgactcctgcttgctgggcgcggcttgggcctccaggctgcgcagcgcagccgctatcgggcggactgcagttcttgccgagcagctactgaaaattaccaaggagaggtaggagataagagatgcctataaaggagctgaaatctaccaggtcgcaatgatttgtatgacagctgctagcccaagagagagttccagaagagggctacctaacaggtgctgtggcatttagaagaggaatggagccattgtcaacgcacagcttgcaggggagcaggagagtcagtctaagaaggaaatgtgatgatggaaacagaggttggaagatggaagaggacccagagtcaaggaatgcaggtagaaaagaaaagcctggattctcccctaaagcctccagatggaacacagccctgcctccaccttgatttcaggacttcttaccccaagaatcgtgtctgtcttcatcctaaggagtcaactgctataccttagtgatttcaatgtaattgtttggtctgtaagtcattcttgccactgtggttctggggccattgttctgcaacgatgaataaacaatgttttagaaatcactcatccaagaaaggtgacaagatactggaatagaggtatttgaaaaatattcatgggaattttagaggattgtagatggtctgaatacctgtgaagacatcatctaatgtatctaaaaaccacataatgcttcatctcaatgtattttaagaattaattttgttataagctagaatttttcattttggttttaataataacatcaaaaggattttttaacataaattagaaagggcatacatggagaagtaaagaagaa

SEQ ID NO: 286009 - DNA, 852 bp, Homo sapiens
gctctgagcaggccgacagtcatagacgagtagaccttaggcgagggaaggcatgtactttccctaagaagcgggaggagagaaataaatagagggcagtgggatgagaagaacctcgcgggatgggaagccgcggagggaagggccgtctttggttacctggagagcgggagcagctgcggatcccttatgaagtgcccggatgaagctccagcgctcacgcgctttccgcattgagtgcagcgccatcttgagaagggcggagccgtcttgtttggaatgacgtctgttcagagagccaatcccagtctcgcgactcctgcttgctgggcgcggcttgggcctccaggctgcgcagcgcagccgctatcgggcggactgcagttcttgccgagcagctactgaaaattaccaaggagaggtaggagataagagatgcctataaaggagctgaaatctaccagggtaagacaaaacagtaaattaaaaccatataggataatcttgtaggtatacaaagtactggtgaagttcaagtataattggtgtaatttagaagtgagcaggaaagggatgaaggcaaaaaaaaaactaggaaatcaagttatagtcttcaacaaagctgatcagtttggttttggctgttaaatttgaggtgcttgtagtacttccaaaatgtgatgcccattaaatagatacatgggtctggagctcagaagagatttgaactaccaaacagatggtaattgaaaccaaggaaatccttgagaccatcagatagagtttgtggagtgaaagtagccagatgatggaaataaaggagccaagaggtgttgtagaacccaaagaatg

SEQ ID NO: 286010 - DNA, 407 bp, Homo sapiens
aatcgaaggtcctctttatgcacagttggactcactcgtcagtcagaccatgcttagttttctgggatatgctctcaccagacaatgattaggacccccaaaaggaggctttttatggaggggtagtgtaataaatacaagaggcaggaagtacaggagacctaggagatggggaggagactgaaggagaagaggttggccctccaagggtggcttccaagactctgaagccaagctgccacctccacaacctcacctagctccccttacccctttctattcctgcagactcaagaggtctgctcatccactccaactccatccgaatcagagatccactggcttcttccagaagcctgcggtggcctgtcctaccccaccggggccacccccagacccctcaccga

SEQ ID NO: 286011 - DNA, 1062 bp, Homo sapiens
ttttcaatccctggggatgaatgttgtaaaattagcacgcagttgccaatccgtaatgaaccctgtttctgggaactgggaggctttagagttgtaacgtgaacagccttttccatcagcctgggtaagggattgacagtccacctccactggtccccctccctccagtgtcccaagatgagtccaaaacccacagtcacatcattcatccactcttcttgtaaaccatggttgccacctactctgtggccagccctgggccgggcgtgggggacatagagacgagtcagacccggaccctgccctcgagacgctcccaggtctggtggggagacagacacgtcatcaaaaagacaagtaagagtgagtgagcacttataggcaagagtgtccgcaggactgtgaaatgaaaacaagttgcagaacaaaggggatggtatgagtgcatgggaaaaataaaacacagaaagaaaaaggagcagaatgaaaaataatgtttttaagccagtgtgacttttcaaaaaatgaaaaggtggtataatgaaaactgattatttaaaacctgggaaaagcagacatcaaattgttctcatcagttacttctggcggtggtttataaggcttttcaacttttatattatatctttgaatgtttttttaaacaaagtaattaatattcacagtgggcccctccagatcaagccatgcttagttttctgggatatgctctcaccagacaatgattaggacccccaaaaggaggctttttatggaggggtagtgtaataaatacaagaggcaggaagtacaggagacctaggagatggggaggagactgaaggagaagaggttggccctccaagggtggcttccaagactctgaagccaagctgccacctccacaacctcacctagctccccttacccctttctattcctgcagactcaagaggtctgctcatccactccaactccatccgaatcagagatccactggcttcttccagaagcctgcggtggcctgtcctaccccaccggggccacccccagacccctcaccga

SEQ ID NO: 286012 - DNA, 950 bp, Homo sapiens
agattctccctgcctccagtttcactccccacctccactggtccccctccctccagtgtcccaagatgagtccaaaacccacagtcacatcattcatccactcttcttgtaaaccatggttgccacctactctgtggccagccctgggccgggcgtgggggacatagagacgagtcagacccggaccctgccctcgagacgctcccaggtctggtggggagacagacacgtcatcaaaaagacaagtaagagtgagtgagcacttataggcaagagtgtccgcaggactgtgaaatgaaaacaagttgcagaacaaaggggatggtatgagtgcatgggaaaaataaaacacagaaagaaaaaggagcagaatgaaaaataatgtttttaagccagtgtgacttttcaaaaaatgaaaaggtggtataatgaaaactgattatttaaaacctgggaaaagcagacatcaaattgttctcatcagttacttctggcggtggtttataaggcttttcaacttttatattatatctttgaatgtttttttaaacaaagtaattaatattcacagtgggcccctccagatcaagccatgcttagttttctgggatatgctctcaccagacaatgattaggacccccaaaaggaggctttttatggaggggtagtgtaataaatacaagaggcaggaagtacaggagacctaggagatggggaggagactgaaggagaagaggttggccctccaagggtggcttccaagactctgaagccaagctgccacctccacaacctcacctagctccccttacccctttctattcctgcagactcaagaggtctgctcatccactccaactccatccgaatcagagatccactggcttcttccagaagcctgcggtggcctgtcctaccccaccggggccacccccagacccctcaccga

SEQ ID NO: 286013 - DNA, 418 bp, Homo sapiens
agttcactcacagctgacttggggtgagggaagaatttgcatttctgacgagatcccaggtgatgttgaggctgctgttcgggggcctcgcttgagaagctccggtgcagagtggacgccttagtctgtttagggagccgcctaacaaactgtatcgccagcctcagggcctcagcctttctgcctttccttccagggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtgaggagcggggctgtgggcctcaggtctcctgcacagtgtccttcacacgtg

SEQ ID NO: 286014 - DNA, 1362 bp, Homo sapiens
ccttctctctctctctccctctccctctcctgccagccaagtgaagacatgcttacttccccttcaccttccttcatgatgacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacct

SEQ ID NO: 286015 - DNA, 1454 bp, Homo sapiens
ccttctctctctctctccctctccctctcctgccagccaagtgaagacatgcttacttccccttcaccttccttcatgatggtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacct

SEQ ID NO: 286016 - DNA, 1688 bp, Homo sapiens
ccttctctctctctctccctctccctctcctgccagccaagtgaagacatgcttacttccccttcaccttccttcatgatgttaccattggaatgacatactgcatcctatagttataccatccactctgaaatcaatgtgaatttaacttcagttccatacagaaacttcttttccacagatggagtttaagcccaagctggagtgcgatggtgcaatcccaactcactgcaacctctgcctcccaggttcaagctattttcctggcttagcctccggagtagctggaattacagatgtgcgcccccatgaccagtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacct

SEQ ID NO: 286017 - DNA, 1554 bp, Homo sapiens
ccttctctctctctctccctctccctctcctgccagccaagtgaagacatgcttacttccccttcaccttccttcatgatgttaccattggaatgacatactgcatcctatagttataccatccactctgaaatcaatgtgaatttaacttcagttccatacagaaacttcttttccacaggtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacct

SEQ ID NO: 286018 - DNA, 1579 bp, Homo sapiens
ccttctctctctctctccctctccctctcctgccagccaagtgaagacatgcttacttccccttcaccttccttcatgatgacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacctaaaaaaaaaacaacaacattgtgccgccgcgcccagcccccacaaaaaagttaaaaaaaccataggtgggggccgcggccccacagcccaggtaaccgtgggcccacacgtcccagaaaaacccggccacgaaaaagggcgggtccccaaaaaaacccggggaacgcgtcagacaacccaagaggcggggcaagggccaagaggccagggccacaac

SEQ ID NO: 286019 - DNA, 1356 bp, Homo sapiens
ccttctctctctctctccctctccctctcctgccagccaagtgaagacatgcttacttccccttcaccttccttcatgatgacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataatggggttggggatggggaaaaaatgaaatgctgggtccaaaaaaaaaa

SEQ ID NO: 286020 - DNA, 1191 bp, Homo sapiens
ccttctctctctctctccctctccctctcctgccagccaagtgaagacatgcttacttccccttcaccttccttcatgatggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacct

SEQ ID NO: 286021 - DNA, 1501 bp, Homo sapiens
ccttctctctctctctccctctccctctcctgccagccaagtgaagacatgcttacttccccttcaccttccttcatgatgtgggaagagtgctgcaacccagccctagccaacgccgcatgagagggagtgtgccgagggcttctgagaaggtttctctcacatctagaaagaagcgcttaagatgtggcagcccctcttcttcaagtggctcttgtcctgttgccctgggagttctcaaattgctgcagcagcctccacccagcctgaggatgacatcaatacacagaggaagaagagtcaggaaaagatgagagaagttacagactctcctgggcgaccccgagagcttaccattcctcagacttcttcacatggtgctaacagatttgttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacct

SEQ ID NO: 286022 - DNA, 1222 bp, Homo sapiens
tttttgctttccattcgaatgagaatattggtattaactttctttggagtgactccaaatgggaaacaacacatgcccgtcaacagatgaatggcactatgccccatccatacaaaatactactactaatctatatgccggaatgtactgatttctgccctaacatcaatacatcgacaaataatattgctgcgttaaagaagaacgagaaggacatatcatatgattccatatatgtaaaagcattgaaaaacaatgaacaaatctatggagaccaaagcttggctggagttggcgggtggcagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacct

SEQ ID NO: 286023 - DNA, 1305 bp, Homo sapiens
cagatacacagcaaatggatatagtcaattatcgtcgatggttgtgaatcatgatgtgaatggtcactgcatgcctgctcctgctgattagagcgactaattcgccctgctcgagagattccgtaaacagctatagatcctacgtacgagagtccgccaagattgaggctggtatcaacgcccggtgttcccccatattgagtgctaggaccagatggttgagcgcataatctgcgagagcctacgggtagaatctaggacccatctccatgagcataagaattgcatgaatggcaccatgtcttcatagatacgaagatcctatatcatatcagtctacagatgctggttggatgcggacatccctgattcgtaccagacgtatctgagtccggaggcataaccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacct

SEQ ID NO: 286024 - DNA, 1610 bp, Homo sapiens
ccttctctctctctctccctctccctctcctgccagccaagtgaagacatgcttacttccccttcaccttccttcatgatgttaccattggaatgacatactgcatcctatagttataccatccactctgaaatcaatgtgaatttaacttcagttccatacagaaacttcttttccacagatggagtttaagcccaagctggagtgcgatggtgcaatcccaactcactgcaacctctgcctcccaggttcaagctattttcctggcttagcctccggagtagctggaattacagatgtgcgcccccatgaccagtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacct

SEQ ID NO: 286025 - DNA, 1191 bp, Homo sapiens
ccttctctctctctctccctctccctctcctgccagccaagtgaagacatgcttacttccccttcaccttccttcatgatgttaccattggaatgacatactgcatcctatagttataccatccactctgaaatcaatgtgaatttaacttcagttccatacagaaacttcttttccacaggtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacct

SEQ ID NO: 286026 - DNA, 1525 bp, Homo sapiens
ccttctctctctctctccctctccctctcctgccagccaagtgaagacatgcttacttccccttcaccttccttcatgatgacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaagggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacctaaaaaaaaaacaacaacattgtgccgccgcgcccagcccccacaaaaaagttaaaaaaaccataggtgggggccgcggccccacagcccaggtaaccgtgggcccacacgtcccagaaaaacccggccacgaaaaagggcgggtccccaaaaaaacccggggaacgcgtcagacaacccaagaggcggggcaagggccaagaggccagggccacaac

SEQ ID NO: 286027 - DNA, 669 bp, Homo sapiens
gatcatctccagctgcctgcggttgaagttggacaccccgatggagtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacct

SEQ ID NO: 286028 - DNA, 1422 bp, Homo sapiens
ccttctctctctctctccctctccctctcctgccagccaagtgaagacatgcttacttccccttcaccttccttcatgatgttaccattggaatgacatactgcatcctatagttataccatccactctgaaatcaatgtgaatttaacttcagttccatacagaaacttcttttccacagatggagtttaagcccaagctggagtgcgatggtgcaatcccaactcactgcaacctctgcctcccaggttcaagctattttcctggcttagcctccggagtagctggaattacagatgtgcgcccccatgaccagtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggtaggcagcttgtgtgatcaaattaatttcacttttgttctcagcataaatattgttttcatggagatttgaactaagctttttcttaggaggacatagggattttaacatggaagaagagccctaaacataactcctaattcctttctatggaacagaaagcaattttgaatccatacttccgtgattgcatgtctacaagaaaagagagtgcagaatcctcaaagcctctgcctcaaaaacttgaggaaatgacaatcatctccttgaaggcacaaggtcttatttatgattcctgatttcacctcttgggatgttcacagacacagagtttcatgaagctgtggtgtccagaaaacctgctgcacatagggtgcacaatgagtttccatcttcttgcctcttttcaaggggcaagaactcagtccgggaatgtcttaaactacaaaccttcatgggaaaccttgttgcttctgcttcctctcttttcacactggaggttttatttttgcttagccatgaattcttgtgtcattcataacttttgtcttaaggtact

SEQ ID NO: 286029 - DNA, 992 bp, Homo sapiens
ccttctctctctctctccctctccctctcctgccagccaagtgaagacatgcttacttccccttcaccttccttcatgatgttaccattggaatgacatactgcatcctatagttataccatccactctgaaatcaatgtgaatttaacttcagttccatacagaaacttcttttccacaggtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggtaacaataatatttttagtgttgagagttcaaaggagctagagtaagtggaagctgaccaggttgtcaggcttgtgttcccatgttactctgcatgactcccctttaaacgtcagtctttgttctgcaatgccgtcttgtcacagggtcatctactgcttatttgtggcactgttttgtcttctgtttatgtttatttcacagcttgtcagagtctataaaactcagcagaaagaacacggcttgcctgctccctctcttgaagattgattgcaatgggagtggtttctctgtttctttgtatagtcgaacagatatttacttcttccaagaagatacaattcagaggaatttttatggcaaaagttagtggagacggggtggatgaaatctgttgggagagtatcactgttctgatgggcggccttgagcaccacactgtaatactagacctggcctaaagagaatttcccatgtactattctcacctctgggaaaattacctgaaataataaaatatcctcattttaagaaaaaaaaaaaaaaac

SEQ ID NO: 286030 - DNA, 542 bp, Homo sapiens
gagagaacggataagaaagatgaggtaggatacatctgtttcctatcttcttagtacaagtatggaaaatgcaccattggatcaaaaacttaggaactttacaaaggtagtttttgtgagcagcgaggaaaaagaaatgacaggcatacaaaagagagaagtggaggagaagaattgggggtaaggaggactgggatttctttccttgcctgtacattaatctctccactttcctaaggaggaaacagaaattctcactcttgcaatcactatcttcttccccaatttttctgttttattttctcccttttaagaaccacggctagctagtttgattgtcacgtctagacagttgttgctttcacagttctatgttacatttatcttgctcttcagtcgactacacaaatgatacctcacaattcctttttcccaggccatggagaagtgtaaagatgcaggattggccaagtccatcggggtgtccaacttcaaccacaggctgctggagatgatcctcaacaagccagggctcaagtaca

SEQ ID NO: 286031 - DNA, 344 bp, Homo sapiens
gagttcactcacagctgacttggggtgagggaagaatttgcatttctgacgagatcccaggtgatgttgaggctgctgttcgggggcctcgcttgagaagctccggtgcagagtggacgccttagtctgtttagggagccgcctaacaaactgtatcgccagcctcagggcctcagcctttctgcctttccttccagggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcg

SEQ ID NO: 286032 - DNA, 281 bp, Homo sapiens
ataatattctcagttcaaatttaatgctctacattattcagcttcttttactttggtgattttaatattaatgtaacttttggattatctgatgcttttccatcttgctcgtctgcaggtggaatgtcatccttacttcaaccagagaaaactgctggatttctgcaagtcaaaagacattgttctggttgcctatagtgctctgggatcccatcgagaagaaccatggtaataagagatacaggaagtttacctaaaacactggtttgataaaaaaaatt

SEQ ID NO: 286033 - DNA, 1379 bp, Homo sapiens
taatttacttgtcttggctattttttgtatgctatgtaagatataaattaatttttcctttggaaaactttcagtatcattgaaagctagtattatttagctttcaacatttattctttattttgttcccccaaacctacctgtctctctctctcctctttctttggttccctaatttaatgttaccaacaactcatggatattaatttcaattagtttgaatgctatttgatactctggtctttgagagaaggcctacataagtcaagccactcctgccggcagcctggcagctgtgttttactgatgtcttttagagacagacatcctgtgtgtgactaaatgtccaaaggggatctatagttaactctatttttaaaagttactgaggtacttcatcataaaaacaacaataaaaatacttcttttaggctgtttttttaggttaagtctacctaaaaaatgatgggtccaggttgatttgtttgttggttttgtgcacacagatattgtacaaagagaacttgagcaaggggactcccctacctgtcactcctgagatggagcgagtcaaactcaatcaagaaaactttagctcggtatttgggagaaagctctttaactccatattaaaaaataataatttctacaaaacagaacatctcactgttcatccctttataataatcaatttaacaaaatctttttttaatcacatcaactgaatccttctggttttccagatctcctactcaccatttgattctaacaaacattttatactttctataatagtcccttaaaactttttctttccttctcttttcatctttatgttgttgggactgttgaagttaattgatttccagaaaagaaaaaccaaacactaaagctcttatttacttggaactctttttatctgatgtttctgggttagagatgcaagaaaagatactggacttgaagccacatatagaaatggtggctcttccttaggaacagggatcatcttaacatagaccctattcagataaacaatagcaccaagaaagaaaattgctccatattgaaaccaaaagaaatcttatttggggccaggcgtggtggctcacacctgtcatctcagcactttgggaggtcgaggcaggcagatcacttgagcccaggaggtcgagaccagcctagccaacatggtgaaattccatctctgctaaaaatagaaaaaattagccaagcgtggtggcacatgcctgtagtctcagctacttgggaggctgaggtgggaggttcatctgaaccctaggaagtcaaggctgcagtgagccgtgattgtgccactgtactccagcctaggcaacaggagtgagaccctgtttcaa

SEQ ID NO: 286034 - DNA, 706 bp, Homo sapiens
tttaaagatacaggattttaattttcttcacataatataggacaaataaagaaaacaaagcaatgttgaaatcttaacaagatgtttactctttcttcatagctccaataccagtgtgaccttaaaaacagtaaaggaaaaattacagttgttcaagacacgccagaaatactgcgtgtaaaagaaaatcagaagaatttcagctcggtatatttactatttattttgcatttaatgctaacctagtcatttcactctcctctttaaaaatatactagccttatattgatacacacaattaacatctaacctcctcagtaatactagcagtgatttgctaaaatccccaatactttgctccaaaatcatctccagagaccatttgaaataactttaaatctgctaacaacgtaacttttatttttaaattttttaatcccagggcagtaacatgtgttgtcttgctccaagaagatggatttctttttgacattgtgatttcttttgttatccctcccccaaataactgactgagtttgcatttctttaatggattttgtgttacatatggggagggttttgttgttaatcaacatttcctggctcttctcatcctgtgttagtatggtataccacaatcttagaagaaatcttaagatctggaaagatccatgttgtaaaactggtctgagtcactgatacggac

SEQ ID NO: 286035 - DNA, 20830 bp, Homo sapiens
  misc_feature (16881)..(16881): n is a, c, g, or t
gtgataaaactacaaagcagaatacgaagaagacagaggcaaaggcttcttccctcagaccataactcaagaatatgggggtctcgcagtaatttatgctctttgcttttgtcttttcatagttttccttgtatagtttgtcacttagggcatctcctgctgccttcagctgcctaagctgtgggttctctgaagcaggaagcacattataatctgcttttcctttattcttttcatagtcttctttgtattttgctgctgaggaaatttatttggtagattgaaggtttgaacgagagctacagaaacgaaagaaaaagtctgtataagccaatggtgttcgggaagaaaataaccccattgccttgagtttgtaggtgccactactactctgaaaaatggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgttgctaagactatatgtcacgtagatgaaaaagcaaaggatattgaacatgcaaagaaagtgtcgcagcaagtcagtaaggttttatacaagcagaactgggaagacaccaaggataagtacctgcttcctcctgatgcccctgaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggccgatcctccagatatagaatttgccaagaaagtaaccaatcaagtgagcaagcaaaaatacaaagaagactatgaaaataaaatcaaaggcaaatggagtgagacaccttgctttgaagttgcaaatgccagaatgaatgctgataacattagcacaaggaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgacgcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaggttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaattacaacctgccaccagacctgccccagttcatccaggctaaagttaatgcctacaatatcagtgagaatatgtacaaagcagacttgaaagacttgagcaagaagggatatgacctgagaactgatgcgattcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtcctgatcttcctcagtttctccaggccaagtgcaatgcttacagtataagtgacgtctgttataaacgggattggcatgacttaatacgcaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttacgatcacagctgcaaagatggcccaggatgtcgctaccaatgtcaactacaaacagccattgcatcattacacatacctacctgacgccatgagtcttgagcatacgaggaatgtcaatcaaattcagagtgataatgtgtataaagacgagtataacagcttcttgaagggcatcggatggatccctattggttccctggaggtggagaaggtcaagaaagcaggcgatgcattaaatgagaggaagtatcgacagcacccagataccgtcaagttcacaagtgtgcctgattccatgggcatgatgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattcgcaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttacgccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagaggaaaagaagaaaggatatgacctgaggcctgatgccattgcaataaaggctgcaagagcctctagagacattgccagtgattacaaatacaagaaagcctatgaacaagccaaagggaaacacattggcttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttcctgatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagaagtaccgccagcacccagacactttgaagtattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatataagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcgggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagcaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggcctataagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccgtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaacaaaacaaagtaaattacagtgagaaattgtataagcttggcctagaagaagccaagaggaaaggttatgacatgcgggtagatgccattcctatcaaggcagccaaggcctccagagatattgcaagtgaattcaagtacaaagaaggctatcgtaagcagctcggccaccacattggtgcccgagctatacgtgatgaccccaagatgatgtggtccatgcacgtggccaagatccagagtgacagggagtacaagaaggactttgagaagtggaagaccaagttcagcagcccagtggacatgctgggggtggtgctggccaagaagtgccagaccttagtcagcgatgtggactacaagaactacctgcaccagtggacatgcctgcccgaccagagcgacgtcatccatgctcggcaggcctatgacctccagagcgataatatgtacaagtctgatctccagtggatgagaggcattggctgggtgtccattggctctttggatgtggaaaaatgcaaaagggcaactgaaattttgagtgataaaatctatcgccagcctccagacagattcaaatttaccagtgtgactgactctctggaacaagtgctggccaagaacaatgctctcaacatgaataagcgtttatacacagaggcctgggacaaagacaagactcaaattcacataatgcctgatacaccagagattatgttggcaaggcagaacaaaatcaactacagtgagactctatacaaacttgccaatgaagaagcaaaaaagaaaggctacgacttgcgaagtgacgccatccccatcgtggctgccaaggcctccagggacgttatcagtgattacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgataacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaagcgcttatacacagaagcctgggacaaagacaagacccaagtccatattatgcctgatacacctgaaatcatgttggcaagacaaaataaaataaattatagtgagagcctctatcgtcaggccatggaagaagccaagaaagaaggctatgacttgagaagtgatgccattcccattgtggctgccaaggcctctcgggatattgccagtgattacaaatacaaagaagcatatcgtaagcagttgggtcaccacattggcgcccgagcagtacacgatgaccccaagataatgtggtccctccacattgccaaagtgcagagtgaccgtgagtacaagaaagattttgagaaatacaagacaaggtacagcagcccagtggacatgcttggtatcgttttggccaagaagtgtcagaccttggtcagcgatgtggactataaacatcctctgcatgaatgcatctgcctgcccgaccagaatgacatcattcatgcacggaaagcctatgacctccagagtgacaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataagcgcttatatactgaagcctgggacaatgacaagaaaactattcatgtcatgcctgatacaccagaaatcatgttagccaaactcaaccgaataaactacagtgataaactctataaacttgctttggaagagtccaagaaggaaggctatgacttgcgtctggatgccattccaatccaagcagccaaggcttcaagagatattgctagtgattacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagtatcgccagcctgcagaccagctcaaattcacatgcattaccgacactccggaaattgtcctagcaaagaataatgccctgacaatgagcaagcatttatacacagaagcttgggatgctgacaaaacctccatccacgtgatgccagacaccccagatatcctgctggccaagagtaattctgccaatatcagccaaaaactttacaccaagggatgggatgaatcaaagatgaaggactatgatctgagagcagatgctatttccatcaaaagtgccaaggcctccagggacatcgccagtgactacaaatacaaggaagcctatgagaaacagaaaggccaccacattggagcccagagcattgaagatgatcccaagattatgtgtgccatacatgcagaaaaaattcaaagtgaaagggagtacaagaaggaattccaaaagtggaaaaccaagttctctagcccagtggacatgttaagcatcttgctggccaagaaatgtcagactttggtcactgacatttattatcgcaattacctgcatgaatggacatgcatgccggatcaaaacgacattatccaagcaaaaaaggcctatgacctgcagagtgatgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttacaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagaaaaaatacagagctgattatgagcagcggaaagataaataccacctggtagtcgatgagcctagacatctgctggctaagacccgcaggcgaccagatcagtcagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacncccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcggtgttatacaaagaaaacatgggcaagggaactcctttacctgtcactcccgagatggagcgagtcaaacacaatcaagaaaatattagctcggtgttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcgtcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 286036 - DNA, 9479 bp, Homo sapiens
  misc_feature (5809)..(5809): n is a, c, g, or t
agagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccgctggtcttgctttcccgaccagaatgatgtgatccaagccaggaaagcctacgacctacagagcgacgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttacaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagaaaaaatacagagctgattatgagcagcggaaagataaataccacctggtagtcgatgagcctagacatctgctggctaagacccgcaggcgaccagatcagtcagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacncccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggtgttatacaaagaaaacatgggcaagggaactcctttacctgtcactcccgagatggagcgagtcaaacacaatcaagaaaatattagctcggtgttgtacaaagaaaatgtggggaaagccaccgcaacccctgtcactcctgagatgcagagagtcaaacgcaatcaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcgtcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 286037 - DNA, 2104 bp, Homo sapiens
atcataaaaacacgcctttctcattcaactgaaaaacacactaaaattttaaaagagaaaaatgcaacatcttggaaagtaacgttttaacaccataaaaatttgcacttattcaactgaaaatttacactaaaatagacattaactgtgcttttacattccaaaccatcatactaaacataacaagttaattgccaatgttttccttcccctatactttgaggtagttctacgtaaccaactataacaaatttacttcctaacatcctcaatcttctgctctcctttagttttaagatactttatgacatgggtaatactctgaaatggatgccttctttggatatattttggggttttagtgtctggaggactttgatttctatattagcatattggtttatgaagtctggacataacctaaggaaaataatcacttgttttaaaggacagttctttcaaattccctacaatgtcagatttagagccaaataccatcgaatatgttgatgctgtaattcctagcaaatttcaagaggtcactctcttttcaaaattataccgtgccccttctttgaaaatgagtttcattttcgaagtcaaaacaagtcctttctcttccactggcgggcccttctggtccccagattagcctgttccaaaattggtcatgtgtctcactgggccccttcagttgacccaagcgtccctcaccagctcctatccatctctatctgctggaaaggctttgaggtttcagatttaggacagcaccactcattcatggtctctcctgcatcaggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtaactgagcctgggttgggggaggggattaactttaagtgagggggtagaagaacaaaagtagcattacctacatcaagtcaaaacataaaggacttcaatctgtttttctagaggtgcaagaaagctcctattatctcatagtttacaaagctgatttctaccttatctttgttctcctctgaggaaaagacatgacccagaacctaagctggaataagtgtgattcaatcctttggtggttgttaaaattcatgccttggttttcaagttattggaaaactccaagaacacttgttctgatcactggtttccctttcaggtttacgtgtctggcgtactaatcctggttcggtttttgactatgatccagcagaagacaacatccagtcccgaagcttacacatgattaatggtgtgttagctgaaaaaggcttacaacataaacatcaccatttagtatgctagagtcaatgactttcatttgggctctgaagttccttccctccagagttttccattttctgagctgcccatttggcataaaaataccttgttaactagtgagcaaaacttactttctagataagttcaagttagaaaaaattttgtttcactgcctcagtgcatgtctcccattattatcatttctaattttttcttccaaagaaaaaacagtagtaattctattggagaaataatgaaaatacataaaatacataggcaaagggaagagaaaggatttgacctgtaggaacttcctgagctctattgcatcaaggaagtttattcattacacaaagcaggctgcacaacttcattccttcttttcatgttaaaaagcagaatactagcctggaaaagagaatgagaccccttttctacaaacagtaaaaaaaaattagccgcgagtggtgttgtacacctgtagtaccagctgttcagggggctgaagtgggaggatagcttgagcctagaaagttgaagctgcagtgagccgtgattgtacc

SEQ ID NO: 286038 - DNA, 9571 bp, Homo sapiens
  misc_feature (5808)..(5808): n is a, c, g, or t
agagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccgctggtcttgctttcccgaccagaatgatgtgatccaagccaggaaagcctacgacctacagagcgacgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttacaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagagaaaatataaatctagtgccaagatgtttctgcaacatggatgtaatgaaattctgcgtccagatatgttgactgctctctacaattcgcatatgtggagccagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacncccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcggtgttgtacaaagaaaatgtggggaaagccaccgcaacccctgtcactcctgagatgcagagagtcaaacgcaatcaagaaaacattagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcgtcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 286039 - DNA, 6851 bp, Homo sapiens
  misc_feature (3088)..(3088): n is a, c, g, or t
gtgaacgcagtgaatcgtatcatgtcatagctgttccatgatgtaacaacccggcaccttgccggtcgttaattggaagacgcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagagaaaatataaatctagtgccaagatgtttctgcaacatggatgtaatgaaattctgcgtccagatatgttgactgctctctacaattcgcatatgtggagccagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacncccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcggtgttgtacaaagaaaatgtggggaaagccaccgcaacccctgtcactcctgagatgcagagagtcaaacgcaatcaagaaaacattagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcgtcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 286040 - DNA, 9478 bp, Homo sapiens
  misc_feature (5808)..(5808): n is a, c, g, or t
agagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccgctggtcttgctttcccgaccagaatgatgtgatccaagccaggaaagcctacgacctacagagcgacgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttacaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagagaaaatataaatctagtgccaagatgtttctgcaacatggatgtaatgaaattctgcgtccagatatgttgactgctctctacaattcgcatatgtggagccagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacncccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcgtcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 286041 - DNA, 3086 bp, Homo sapiens
gagcaaggccagtgatcatatatttgaatgcctgttgtcttgtcattcttaattattaatagtgtcttctttactctaaatgtcccagtttggataatagattatatgatcactctatgtacaatgcatattctttggcatttgtgtttctactattccccaattcccaaattgattgatgtccaggaataatttggatgtttgcatttgctgttaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcggtgttgtacaaagaaaatgtggggaaagccaccgcaacccctgtcactcctgagatgcagagagtcaaacgcaatcaagaaaacattagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcgtcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 286042 - DNA, 2037 bp, Homo sapiens
tttaaagatacaggattttaattttcttcacataatataggacaaataaagaaaacaaagcaatgttgaaatcttaacaagatgtttactctttcttcatagctccaataccagtgtgaccttaaaaactgggaacatcgtctagtgtcttgttttcacaaaagccatgtgtcctagtctttctccaggaactgctgggttttcttttcttctgtgttaacactgtcctgattctgaatgcccaggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcggtgttgtacaaagaaaatgtggggaaagccaccgcaacccctgtcactcctgagatgcagagagtcaaacgcaatcaagaaaacattagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcgtcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 286043 - DNA, 1978 bp, Homo sapiens
aatcttttttttaaaataatgagtttttcagtttgtgtggataacaccactgagttctaactgtctcaaatcctcatataattgtttaggaggcatggtactcacaaaaaaggaaaaaaaaaaataacatggataactctgacagcctttccccagcagctgaggtccctgcttctctagagggtgcagattccccatcccaacaacttccactaaagtaaagtagtcggtggcattttgtcagcatataacttctggctccttggacaactgtgttttgtcttaacaaggaagctgaccttacccttaaaacctttcaacaaatgaaatgttactcatggttgtttttctggttgctttcttatcgcacaggtgttatacaaagaaaacatgggcaagggaacccctctacctgtcactcctgagatggagagagtcaaacacaatcaagaaaatattagctcggtgttatacaaagaaaacatgggcaagggaactcctttacctgtcactcccgagatggagcgagtcaaacacaatcaagaaaatattagctcggtgttgtacaaagaaaatgtggggaaagccaccgcaacccctgtcactcctgagatgcagagagtcaaacgcaatcaagaaaacattagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcgtcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 286044 - DNA, 1977 bp, Homo sapiens
agctcactgtgactcccgagagggacacagtccaacgcggtcagttaacacctgtatcctcggcttgttgtctaaagaagatacttggggcgatagaggtaatcgctaaggactatcactccagaagatgggcacgagtggaacgcgatcgtgataacttaagtcccggatggtatacatgagaatcactctggtggactcgtgatcttccagggcgctccatcgacgtcctgtagatgtcagagtagatcgcaccgacatgagaaaaccttagctcggtgttatacaaagaaaacatgggcaagggaacccctttacctgtcactcccgagatggaaagagtcaaacacaatcaagaaaatattagctcggtgttatacaaagaaaacatgggcaagggaacccctctacctgtcactcctgagatggagagagtcaaacacaatcaagaaaatattagctcggtgttatacaaagaaaacatgggcaagggaactcctttacctgtcactcccgagatggagcgagtcaaacacaatcaagaaaatattagctcggtgttgtacaaagaaaatgtggggaaagccaccgcaacccctgtcactcctgagatgcagagagtcaaacgcaatcaagaaaacattagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcgtcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 286045 - DNA, 2071 bp, Homo sapiens
aatcttttttttaaaataatgagtttttcagtttgtgtggataacaccactgagttctaactgtctcaaatcctcatataattgtttaggaggcatggtactcacaaaaaaggaaaaaaaaaaataacatggataactctgacagcctttccccagcagctgaggtccctgcttctctagagggtgcagattccccatcccaacaacttccactaaagtaaagtagtcggtggcattttgtcagcatataacttctggctccttggacaactgtgttttgtcttaacaaggaagctgaccttacccttaaaacctttcaacaaatgaaatgttactcatggttgtttttctggttgctttcttatcgcacaggtgttatacaaagaaaacatgggcaagggaacccctctacctgtcactcctgagatggagagagtcaaacacaatcaagaaaatattagctcggtgttatacaaagaaaacatgggcaagggaactcctttacctgtcactcccgagatggagcgagtcaaacacaatcaagaaaatattagctcggtgttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcgtcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 286046 - DNA, 2036 bp, Homo sapiens
atcataaaaacacgcctttctcattcaactgaaaaacacactaaaattttaaaagagaaaaatgcaacatcttggaaagtaacgttttaacaccataaaaatttgcacttattcaactgaaaatttacactaaaatagacattaactgtgcttttacattccaaaccatcatactaaacataacaagttaattgccaatgttttccttcccctatactttgaggtagttctacgtaaccaactataacaaatttacttcctaacatcctcaatcttctgctctcctttagttttaagatactttatgacatgggtaatactctgaaatggatgccttctttggatatattttggggttttagtgtctggaggactttgatttctatattagcatattggtttatgaagtctggacataacctaaggaaaataatcacttgttttaaaggacagttctttcaaattccctacaatgtcagatttagagccaaataccatcgaatatgttgatgctgtaattcctagcaaatttcaagaggtcactctcttttcaaaattataccgtgccccttctttgaaaatgagtttcattttcgaagtcaaaacaagtcctttctcttccactggcgggcccttctggtccccagattagcctgttccaaaattggtcatgtgtctcactgggccccttcagttgacccaagcgtccctcaccagctcctatccatctctatctgctggaaaggctttgaggtttcagatttaggacagcaccactcattcatggtctctcctgcatcaggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcgtcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 286047 - DNA, 9639 bp, Homo sapiens
  misc_feature (5808)..(5808): n is a, c, g, or t
agagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccgctggtcttgctttcccgaccagaatgatgtgatccaagccaggaaagcctacgacctacagagcgacgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttacaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagagaaaatataaatctagtgccaagatgtttctgcaacatggatgtaatgaaattctgcgtccagatatgttgactgctctctacaattcgcatatgtggagccagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacncccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcggtgttgtacaaagaaaatgtggggaaagccaccgcaacccctgtcactcctgagatgcagagagtcaaacgcaatcaagaaaacattagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtaactgagcctgggttgggggaggggattaactttaagtgagggggtagaagaacaaaagtagcattacctacatcaagtcaaaacataaaggacttcaatctgtttttctagaggtgcaagaaagctcctattatctcatagtttacaaagctgatttctaccttatctttgttctcctctgaggaaaagacatgacccagaacctaagctggaataagtgtgattcaatcctttggtggttgttaaaattcatgccttggttttcaagttattggaaaactccaagaacacttgttctgatcactggtttccctttcaggtttacgtgtctggcgtactaatcctggttcggtttttgactatgatccagcagaagacaacatccagtcccgaagcttacacatgattaatggtgtgttagctgaaaaaggcttacaacataaacatcaccatttagtatgctagagtcaatgactttcatttgggctctgaagttccttccctccagagttttccattttctgagctgcccatttggcataaaaataccttgttaactagtgagcaaaacttactttctagataagttcaagttagaaaaaattttgtttcactgcctcagtgcatgtctcccattattatcatttctaattttttcttccaaagaaaaaacagtagtaattctattggagaaataatgaaaatacataaaatacataggcaaagggaagagaaaggatttgacctgtaggaacttcctgagctctattgcatcaaggaagtttattcattacacaaagcaggctgcacaacttcattccttcttttcatgttaaaaagcagaatactagcctggaaaagagaatgagaccccttttctacaaacagtaaaaaaaaattagccgcgagtggtgttgtacacctgtagtaccagctgttcagggggctgaagtgggaggatagcttgagcctagaaagttgaagctgcagtgagccgtgattgtacc

SEQ ID NO: 286048 - DNA, 8687 bp, Homo sapiens
  misc_feature (5808)..(5808): n is a, c, g, or t
agagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccgctggtcttgctttcccgaccagaatgatgtgatccaagccaggaaagcctacgacctacagagcgacgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttacaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagagaaaatataaatctagtgccaagatgtttctgcaacatggatgtaatgaaattctgcgtccagatatgttgactgctctctacaattcgcatatgtggagccagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacncccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcggtatttcttagggggccaaaaaaaaaaaaatcccttaattttatttaaaataataacaccttacaaatgtaaaattactaaattcatataatgaaaataatgataccaaatattacctcagttttcaacccaaatctaatttagtatttagttctggtgtgaaattttaactgtgttttctctaaaacatagatatttatcactttctttaaaaacctgtaatactctgttttcttcctccattcctcctttaataacagtaggtgtttctaactggtgtaacacagtcaaaagtaaaatctaacaccctttcaaaaggacaatgttaattagaattttatttgtatttattgtggctgtttaatgtattctttatgtttgcagcttttaagtttttttttttttatgtttagatgtttatttatttttccataagtttgggaggtacaggtggtatttggttactaagttctttagtggtgacttgtgagattttggtgcacccatcacccaagcagtatacactgcaccatatt

SEQ ID NO: 286049 - DNA, 8278 bp, Homo sapiens
  misc_feature (5808)..(5808): n is a, c, g, or t
agagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccgctggtcttgctttcccgaccagaatgatgtgatccaagccaggaaagcctacgacctacagagcgacgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttacaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagagaaaatataaatctagtgccaagatgtttctgcaacatggatgtaatgaaattctgcgtccagatatgttgactgctctctacaattcgcatatgtggagccagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacncccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggtatatttactatttattttgcatttaatgctaacctagtcatttcactctcctctttaaaaatatactagccttatattgatacacacaattaacatctaacctcctcagtaatactagcagtgatttgctaaaatccccaatactttgctccaaaatcatctccagagaccatttgaaataactttaaatctgctaacaacgtaacttttatttttaaattttttaatcccagggcagtaacatgtgttgtcttgctccaagaagatggatttctttttgacattgtgatttcttttgttatccctcccccaaataactgactgagtttgcatttctttaatggattttgtgttacatatggggagggttttgttgttaatcaacatttcctggctcttctcatcctgtgttagtatggtataccacaatcttagaagaaatcttaagatctggaaagatccatgttgtaaaactggtctgagtcactgatacggac

SEQ ID NO: 286050 - DNA, 7827 bp, Homo sapiens
  misc_feature (5808)..(5808): n is a, c, g, or t
agagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccgctggtcttgctttcccgaccagaatgatgtgatccaagccaggaaagcctacgacctacagagcgacgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttacaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagagaaaatataaatctagtgccaagatgtttctgcaacatggatgtaatgaaattctgcgtccagatatgttgactgctctctacaattcgcatatgtggagccagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacncccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaagaaaaatagcagagatgttcaccttttccttgctgattgctaatgcttattatttctaattcagttctgaagttataaacttataatcaatacaaaccagcaactaataaaacctctaattctgcaa

SEQ ID NO: 286051 - DNA, 1287 bp, Homo sapiens
  misc_feature (1225)..(1225): n is a, c, g, or t
  misc_feature (1249)..(1249): n is a, c, g, or t
  misc_feature (1277)..(1277): n is a, c, g, or t
aatcttttttttaaaataatgagtttttcagtttgtgtggataacaccactgagttctaactgtctcaaatcctcatataattgtttaggaggcatggtactcacaaaaaaggaaaaaaaaaaataacatggataactctgacagcctttccccagcagctgaggtccctgcttctctagagggtgcagattccccatcccaacaacttccactaaagtaaagtagtcggtggcattttgtcagcatataacttctggctccttggacaactgtgttttgtcttaacaaggaagctgaccttacccttaaaacctttcaacaaatgaaatgttactcatggttgtttttctggttgctttcttatcgcacaggtgttatacaaagaaaacatgggcaagggaacccctctacctgtcactcctgagatggagagagtcaaacacaatcaagaaaatattagctcggtgttatacaaagaaaacatgggcaagggaactcctttacctgtcactcccgagatggagcgagtcaaacacaatcaagaaaatattagctcggtgttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatggtnccaaggcttcaagaggccccgganccccgggaagcaagtcaccgaatcttgnccagtggcac

SEQ ID NO: 286052 - DNA, 310 bp, Homo sapiens
gtgggtattttcttaggaaagacagggagtagagactagggatgaatgttaatcattcggtctctaatacatatgttttggggtatttttttttctttagttgatctacaaatcagacttcttcaagatgcagggccacatgatctctctgccatacacaccccaagtgatccattgccgctatgtgggagacatcaccagtgatgtaagcatctcgtaggggtctttctggagtagtcttaccaagacgcaggcttgctttcagcagttaaaacaaccagtggtctttgaacagccttttctgataagc

SEQ ID NO: 286053 - DNA, 381 bp, Homo sapiens
ttagaataataaaaactttattaataacaaaaattttattaagtaatacagtattgtcttggtttgcttattaattttaagcaaaaactctaataaaagggaataatacagattttatatcaaatttgagtaacttacgtgaaaagattccagaaatctttgccctaacatgaaagggttttggatcaaatccaaaagaaaatttaaaagttgcatagtgggactagcaacatgaaaattgtgaagtaattttattatttttgtttctttccacagccaaagtacagagaggtttgggacaaggataaaacttcaatacacataatgccagatactccagaaattaatctcgctagagcaaatgctcttaatgtgagcaat

SEQ ID NO: 286054 - DNA, 335 bp, Homo sapiens
ctcactttgatttccattagtgctgttccatttcctatttacgtgatttcctttcttcccccataacacacaggttaaatacaaggctgacctgaagaaacttcacaaacccgtgactgacatgaaggagtctctgatcatgaatcatgtcctgaatacaagccaacttgccagttctgtaagctcagtcatttgctccagaaacagcttgttttacccatttggaactaaattctttctgagcccagatgcatcttcttctctgctactgataccctagatttattacaaaactgttctcatttgagtgtattcttccaaatgacaacattaat

SEQ ID NO: 286055 - DNA, 546 bp, Homo sapiens
gagcccccagaagcccagagcagtcaggtcacacgacgggcaggaaggagtaccagcaaatactttttattgagcatacaggtattacgctgggtctttacatatctcctccaaataagtgagtccaaatggcaggtaactcgaaaggtgagaaattcaagtcagctttgaaagacacattgcatttaaaggaaaaacggtattcgcagatgataatacaggatggagtggatcagaaaacacactgaggctactgatcattcccatttgccaactcactgcagttggcaagaaaactctgtgactccatgagatgggaaattacaccagcagtcaaggtagcaaggtaatagtttcggctaagttttgctgcataacaaactgcctcaaatagtggtttatatctctaacgtgggcaaggtgggtgattcttctgctagtttctcctgggcatattcatgtggcttcattcagcacaggttgctacgctgggcggtccaagatagccttattcatgctctggcaggtgctgcctggctgctaggg

SEQ ID NO: 286056 - DNA, 1002 bp, Homo sapiens
cgttccatccaggtgcggcagcctcaggcagagattaagaaatgagtcgtggaaaagggggctagcggctggttactaggagacgggacgctcggctcgggcgtctaggcgctgcgtgggcgtgcgcctgcgcggcgcggatgggccaggaaggggtccctcctaggtgccctgtaaggcaggcaggtagacgtacgcgtcgctccgtgcgtaggagcgcgcgcacggcttgtagaccccgcgagaaggaaggtcgagccagattgaagatctcaaacagacaaatcatggcttggaagaatatgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagattgatctcatttgccagcaaaataatattatagtattggaagatacaataaaaaggcttaaatctacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggccggagaaataccgattcgccgagaatgtgaaagtgtagaggcttaatcacacggcattgcatctcgggagggagagaaaaatgtgtatgatagagatgccgacggattaaggagaaatggcaaaggttaggaggctcgaaaaggggggtctctaaaaaagttggaaaggctcg

SEQ ID NO: 286057 - DNA, 712 bp, Homo sapiens
acggcgggccgaggagcccggggagggacccggagctccaggttaccaccaaagaatatgattttggtctaggggctccagtttctgaagctgaaaactaccagaatactctccagctagaacaagaagtgagaaaccaagatagattcatctcgacactgaaattacaggttgcgtttagttacaacatattttcctgacttaatttggggtgggagcctattttgaaacaagaagatagagaataaataactactaattcagagctcatttaaatgttatgggtctaaaatcattcaatttttatcttaaccattttgataaacatagagtcagagtcagtgagtgcaaactacgtgtcaagtgttgtgtcagatgttttcaggtatacagtttttacttaatcatccccaacttgcgaaaaagtgatgccgtttccatttatagatgtggaagctgaagttctaagaggttaaataattatgacacttgagtaacaagtgacagaactacgatttctccaaactcccgtgttagccgggatttgaactcaattctctgaacttcaagttcagtattgttcctgttctcctgatgcttgacatgtaatatagctattaataaaggctattaaaagagatttctttttccaggaagatagagtagacttacttttttttattcctcctgctaagtacagctaaaaactctg

SEQ ID NO: 286058 - DNA, 739 bp, Homo sapiens
tgcgcgcgatgctgccccgccccctgagggccggccccctgaagcgcaagagaaggaggggcgcgcagggatcgcgcctagtctctccgcctgcggagccgtggggtcccggcagcccgcaggagtgctaagtaagggtccttcagggcgggaaccaggttccaggcagggacgcaggctacgttcgaataaaagtaccgaaggtcataaggccccagttcagatgggacttccccgcgtgacagcacagagataacggccagccctgggcgaaggttaccaccaaagaatatgattttggtctaggggctccagtttctgaagctgaaaactaccagaatactctccagctagaacaagaagtgagaaaccaagatagattcatctcgacactgaaattacagattgaagatctcaaacagacaaatcatggcttggaagaatatgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagagatatctacaaactaatagatacatttattttcgtctattttcacatatgtaattgatttcaatacccattaaaaaagatttttaccaaactaaaaatagaactgccatgtgatccag

SEQ ID NO: 286059 - DNA, 497 bp, Homo sapiens
tgcgcgcgatgctgccccgccccctgagggccggccccctgaagcgcaagagaaggaggggcgcgcagggatcgcgcctagtctctccgcctgcggagccgtggggtcccggcagcccgcaggagtgctaagtaagggtccttcagggcgggaaccaggttccaggcagggacgcaggctacgttcgaataaaagtaccgaaggtcataaggccccagttcagatgggacttccccgcgtgacagcacagagataacggccagccctgggcgaagatgataatacaggatggagtggatcagaaaacacactgaggctactgatcattcccatttgccaactcactgcagttggcaagaaaactctgtgactccatgagatgggaaattacaccagcagtcaaggtagcaagatttggaacttgaagatgaatttttcttcctcatcaaaggaatatctaatactgccttcaaatgaataaaattgagtttattcta

SEQ ID NO: 286060 - DNA, 360 bp, Homo sapiens
tgcgcgcgatgctgccccgccccctgagggccggccccctgaagcgcaagagaaggaggggcgcgcagggatcgcgcctagtctctccgcctgcggagccgtggggtcccggcagcccgcaggagtgctaagtaagggtccttcagggcgggaaccaggttccaggcagggacgcaggctacgttcgaataaaagtaccgaaggtcataaggccccagttcagatgggacttccccgcgtgacagcacagagataacggccagccctgggcgaagatttggaacttgaagatgaatttttcttcctcatcaaaggaatatctaatactgccttcaaatgaataaaattgagtttattcta

SEQ ID NO: 286061 - DNA, 431 bp, Homo sapiens
gagcccccagaagcccagagcagtcaggtcacacgacgggcaggaaggagtaccagcaaatactttttattgagcatacaggtattacgctgggtctttacatatctcctccaaataagtgagtccaaatggcaggtaactcgaaaggtgagaaattcaagtcagctttgaaagacacattgcatttaaaggaaaaacggtattcgcagatgataatacaggatggagtggatcagaaaacacactgaggctactgatcattcccatttgccaactcactgcagttggcaagaaaactctgtgactccatgagatgggaaattacaccagcagtcaaggtagcaagatttggaacttgaagatgaatttttcttcctcatcaaaggaatatctaatactgccttcaaatgaataaaattgagtttattcta

SEQ ID NO: 286062 - DNA, 353 bp, Homo sapiens
tgcgcgcgatgctgccccgccccctgagggccggccccctgaagcgcaagagaaggaggggcgcgcagggatcgcgcctagtctctccgcctgcggagccgtggggtcccggcagcccgcaggagtgctaaatgataatacaggatggagtggatcagaaaacacactgaggctactgatcattcccatttgccaactcactgcagttggcaagaaaactctgtgactccatgagatgggaaattacaccagcagtcaaggtagcaagatttggaacttgaagatgaatttttcttcctcatcaaaggaatatctaatactgccttcaaatgaataaaattgagtttattcta

SEQ ID NO: 286063 - DNA, 3662 bp, Homo sapiens
caggtatctaacctatctttgtatttttggaatttaatatagttcctgacataatcattgttcaatgggtctaatttttttttcctttaaaggcatttggatacctttgtgatagaaaaggcccttttcttcatccattgatggtttgatagtgggctgggaaggaaagctgtgttcctccacattaggcagcaaatacttgattgatttgatatttagcttagtcaaattgaagatctcaaacagacaaatcatggcttggaagaatatgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagattgatctcatttgccagcaaaataatattatagtattggaagatacaataaaaaggcttaaatctataattttagatactgaaaaagcacaaaataaatctccttctagacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaagagaatctttgctacagagatttctgacacctgaaatgattcttcacatccctgagaaaggtcaaagttacaaactgatttttttttttttgctacatgagtgcatttatcttttaaatgcttggcaatgttaaatgtatttattaactttgtgtctctgaatctctgttctaatgtgccatgttgcagtgatctgagatgacttataaaaacaaaaatgtatatggctctttctatccatgcagtgatagtgagtgtaaaatctgcttacttcactattgaacactattctgttcactatctggagtaaataaagaagcttattaaaacagggaaaagtgtttttacaaaactgctttcctttcctttcttggtatctcaaataattggttggttaattttttttctttgtgatttgtgttttcatggctggaaaatctgtgccaaaatgggtacaacttactgatactggtctgggatctgatattccattttggaaccaaccttacatgaattccatgccataatctgatattgaagcagcagaaagtaggagtgttgtcagggttttaaaacctatagtattgtaccactcaaagactaagtaacatacatattctacaattgtgtttactactactgcttttagaaaggtaggtgatggtatatctgtcaagaatgtaagattttattaaaaatctttatttttaataagttttctttcaagtactgcaatcaacttaattgcgattttattttattgtctgtggcagctgtctgtaatctggagtaataagataagtgatgtttccttcctcccccaatttcctaaatctcttaccttatctatccataggctttgatgtaatgttcatattagagcctgaatgctactgtattttactgatataaactatttgtattcttgccattttaataaaaaaaggcttgtcattaatagtatt

SEQ ID NO: 286064 - DNA, 3917 bp, Homo sapiens
cgttccatccaggtgcggcagcctcaggcagagattaagaaatgagtcgtggaaaagggggctagcggctggttactaggagacgggacgctcggctcgggcgtctaggcgctgcgtgggcgtgcgcctgcgcggcgcggatgggccaggaaggggtccctcctaggtgccctgtaaggcaggcaggtagacgtacgcgtcgctccgtgcgtaggagcgcgcgcacggcttgtagaccccgcgagaaggaaggtcgagccaggttaccaccaaagaatatgattttggtctaggggctccagtttctgaagctgaaaactaccagaatactctccagctagaacaagaagtgagaaaccaagatagattcatctcgacactgaaattacaggcatttggatacctttgtgatagaaaaggcccttttcttcatccattgatggtttgatagtgggctgggaaggaaagctgtgttcctccacattaggcagcaaatacttgattgatttgatatttagcttagtcaaattgaagatctcaaacagacaaatcatggcttggaagaatatgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagattgatctcatttgccagcaaaataatattatagtattggaagatacaataaaaaggcttaaatctacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaagagaatctttgctacagagatttctgacacctgaaatgattcttcacatccctgagaaaggtcaaagttacaaactgatttttttttttttgctacatgagtgcatttatcttttaaatgcttggcaatgttaaatgtatttattaactttgtgtctctgaatctctgttctaatgtgccatgttgcagtgatctgagatgacttataaaaacaaaaatgtatatggctctttctatccatgcagtgatagtgagtgtaaaatctgcttacttcactattgaacactattctgttcactatctggagtaaataaagaagcttattaaaacagggaaaagtgtttttacaaaactgctttcctttcctttcttggtatctcaaataattggttggttaattttttttctttgtgatttgtgttttcatggctggaaaatctgtgccaaaatgggtacaacttactgatactggtctgggatctgatattccattttggaaccaaccttacatgaattccatgccataatctgatattgaagcagcagaaagtaggagtgttgtcagggttttaaaacctatagtattgtaccactcaaagactaagtaacatacatattctacaattgtgtttactactactgcttttagaaaggtaggtgatggtatatctgtcaagaatgtaagattttattaaaaatctttatttttaataagttttctttcaagtactgcaatcaacttaattgcgattttattttattgtctgtggcagctgtctgtaatctggagtaataagataagtgatgtttccttcctcccccaatttcctaaatctcttaccttatctatccataggctttgatgtaatgttcatattagagcctgaatgctactgtattttactgatataaactatttgtattcttgccattttaataaaaaaaggcttgtcattaatagtatt

SEQ ID NO: 286065 - DNA, 3737 bp, Homo sapiens
acgcgtgcgcaccgggcctgggggcgagcgggacggaagcaaagctggggcgccggggaggtggaagacgagccccactccggttaccaccaaagaatatgattttggtctaggggctccagtttctgaagctgaaaactaccagaatactctccagctagaacaagaagtgagaaaccaagatagattcatctcgacactgaaattacaggcatttggatacctttgtgatagaaaaggcccttttcttcatccattgatggtttgatagtgggctgggaaggaaagctgtgttcctccacattaggcagcaaatacttgattgatttgatatttagcttagtcaaattgaagatctcaaacagacaaatcatggcttggaagaatatgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagattgatctcatttgccagcaaaataatattatagtattggaagatacaataaaaaggcttaaatctacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaagagaatctttgctacagagatttctgacacctgaaatgattcttcacatccctgagaaaggtcaaagttacaaactgatttttttttttttgctacatgagtgcatttatcttttaaatgcttggcaatgttaaatgtatttattaactttgtgtctctgaatctctgttctaatgtgccatgttgcagtgatctgagatgacttataaaaacaaaaatgtatatggctctttctatccatgcagtgatagtgagtgtaaaatctgcttacttcactattgaacactattctgttcactatctggagtaaataaagaagcttattaaaacagggaaaagtgtttttacaaaactgctttcctttcctttcttggtatctcaaataattggttggttaattttttttctttgtgatttgtgttttcatggctggaaaatctgtgccaaaatgggtacaacttactgatactggtctgggatctgatattccattttggaaccaaccttacatgaattccatgccataatctgatattgaagcagcagaaagtaggagtgttgtcagggttttaaaacctatagtattgtaccactcaaagactaagtaacatacatattctacaattgtgtttactactactgcttttagaaaggtaggtgatggtatatctgtcaagaatgtaagattttattaaaaatctttatttttaataagttttctttcaagtactgcaatcaacttaattgcgattttattttattgtctgtggcagctgtctgtaatctggagtaataagataagtgatgtttccttcctcccccaatttcctaaatctcttaccttatctatccataggctttgatgtaatgttcatattagagcctgaatgctactgtattttactgatataaactatttgtattcttgccattttaataaaaaaaggcttgtcattaatagtatt

SEQ ID NO: 286066 - DNA, 3601 bp, Homo sapiens
acgcgtgcgcaccgggcctgggggcgagcgggacggaagcaaagctggggcgccggggaggtggaagacgagccccactccggttaccaccaaagaatatgattttggtctaggggctccagtttctgaagctgaaaactaccagaatactctccagctagaacaagaagtgagaaaccaagatagattcatctcgacactgaaattacagattgaagatctcaaacagacaaatcatggcttggaagaatatgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagattgatctcatttgccagcaaaataatattatagtattggaagatacaataaaaaggcttaaatctacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaagagaatctttgctacagagatttctgacacctgaaatgattcttcacatccctgagaaaggtcaaagttacaaactgatttttttttttttgctacatgagtgcatttatcttttaaatgcttggcaatgttaaatgtatttattaactttgtgtctctgaatctctgttctaatgtgccatgttgcagtgatctgagatgacttataaaaacaaaaatgtatatggctctttctatccatgcagtgatagtgagtgtaaaatctgcttacttcactattgaacactattctgttcactatctggagtaaataaagaagcttattaaaacagggaaaagtgtttttacaaaactgctttcctttcctttcttggtatctcaaataattggttggttaattttttttctttgtgatttgtgttttcatggctggaaaatctgtgccaaaatgggtacaacttactgatactggtctgggatctgatattccattttggaaccaaccttacatgaattccatgccataatctgatattgaagcagcagaaagtaggagtgttgtcagggttttaaaacctatagtattgtaccactcaaagactaagtaacatacatattctacaattgtgtttactactactgcttttagaaaggtaggtgatggtatatctgtcaagaatgtaagattttattaaaaatctttatttttaataagttttctttcaagtactgcaatcaacttaattgcgattttattttattgtctgtggcagctgtctgtaatctggagtaataagataagtgatgtttccttcctcccccaatttcctaaatctcttaccttatctatccataggctttgatgtaatgttcatattagagcctgaatgctactgtattttactgatataaactatttgtattcttgccattttaataaaaaaaggcttgtcattaatagtatt

SEQ ID NO: 286067 - DNA, 3781 bp, Homo sapiens
acgcgtgcgcaccgggcctgggggcgagcgggacggaagcaaagctggggcgccggggaggtggaagacgagccccactccggttaccaccaaagaatatgattttggtctaggggctccagtttctgaagctgaaaactaccagaatactctccagctagaacaagaagtgagaaaccaagatagattcatctcgacactgaaattacaggcatttggatacctttgtgatagaaaaggcccttttcttcatccattgatggtttgatagtgggctgggaaggaaagctgtgttcctccacattaggcagcaaatacttgattgatttgatatttagcttagtcaaattgaagatctcaaacagacaaatcatggcttggaagaatatgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagattgatctcatttgccagcaaaataatattatagtattggaagatacaataaaaaggcttaaatctataattttagatactgaaaaagcacaaaataaatctccttctagacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaagagaatctttgctacagagatttctgacacctgaaatgattcttcacatccctgagaaaggtcaaagttacaaactgatttttttttttttgctacatgagtgcatttatcttttaaatgcttggcaatgttaaatgtatttattaactttgtgtctctgaatctctgttctaatgtgccatgttgcagtgatctgagatgacttataaaaacaaaaatgtatatggctctttctatccatgcagtgatagtgagtgtaaaatctgcttacttcactattgaacactattctgttcactatctggagtaaataaagaagcttattaaaacagggaaaagtgtttttacaaaactgctttcctttcctttcttggtatctcaaataattggttggttaattttttttctttgtgatttgtgttttcatggctggaaaatctgtgccaaaatgggtacaacttactgatactggtctgggatctgatattccattttggaaccaaccttacatgaattccatgccataatctgatattgaagcagcagaaagtaggagtgttgtcagggttttaaaacctatagtattgtaccactcaaagactaagtaacatacatattctacaattgtgtttactactactgcttttagaaaggtaggtgatggtatatctgtcaagaatgtaagattttattaaaaatctttatttttaataagttttctttcaagtactgcaatcaacttaattgcgattttattttattgtctgtggcagctgtctgtaatctggagtaataagataagtgatgtttccttcctcccccaatttcctaaatctcttaccttatctatccataggctttgatgtaatgttcatattagagcctgaatgctactgtattttactgatataaactatttgtattcttgccattttaataaaaaaaggcttgtcattaatagtatt

SEQ ID NO: 286068 - DNA, 3825 bp, Homo sapiens
cgttccatccaggtgcggcagcctcaggcagagattaagaaatgagtcgtggaaaagggggctagcggctggttactaggagacgggacgctcggctcgggcgtctaggcgctgcgtgggcgtgcgcctgcgcggcgcggatgggccaggaaggggtccctcctaggtgccctgtaaggcaggcaggtagacgtacgcgtcgctccgtgcgtaggagcgcgcgcacggcttgtagaccccgcgagaaggaaggtcgagccaggttaccaccaaagaatatgattttggtctaggggctccagtttctgaagctgaaaactaccagaatactctccagctagaacaagaagtgagaaaccaagatagattcatctcgacactgaaattacagattgaagatctcaaacagacaaatcatggcttggaagaatatgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagattgatctcatttgccagcaaaataatattatagtattggaagatacaataaaaaggcttaaatctataattttagatactgaaaaagcacaaaataaatctccttctagacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaagagaatctttgctacagagatttctgacacctgaaatgattcttcacatccctgagaaaggtcaaagttacaaactgatttttttttttttgctacatgagtgcatttatcttttaaatgcttggcaatgttaaatgtatttattaactttgtgtctctgaatctctgttctaatgtgccatgttgcagtgatctgagatgacttataaaaacaaaaatgtatatggctctttctatccatgcagtgatagtgagtgtaaaatctgcttacttcactattgaacactattctgttcactatctggagtaaataaagaagcttattaaaacagggaaaagtgtttttacaaaactgctttcctttcctttcttggtatctcaaataattggttggttaattttttttctttgtgatttgtgttttcatggctggaaaatctgtgccaaaatgggtacaacttactgatactggtctgggatctgatattccattttggaaccaaccttacatgaattccatgccataatctgatattgaagcagcagaaagtaggagtgttgtcagggttttaaaacctatagtattgtaccactcaaagactaagtaacatacatattctacaattgtgtttactactactgcttttagaaaggtaggtgatggtatatctgtcaagaatgtaagattttattaaaaatctttatttttaataagttttctttcaagtactgcaatcaacttaattgcgattttattttattgtctgtggcagctgtctgtaatctggagtaataagataagtgatgtttccttcctcccccaatttcctaaatctcttaccttatctatccataggctttgatgtaatgttcatattagagcctgaatgctactgtattttactgatataaactatttgtattcttgccattttaataaaaaaaggcttgtcattaatagtatt

SEQ ID NO: 286069 - DNA, 3781 bp, Homo sapiens
cgttccatccaggtgcggcagcctcaggcagagattaagaaatgagtcgtggaaaagggggctagcggctggttactaggagacgggacgctcggctcgggcgtctaggcgctgcgtgggcgtgcgcctgcgcggcgcggatgggccaggaaggggtccctcctaggtgccctgtaaggcaggcaggtagacgtacgcgtcgctccgtgcgtaggagcgcgcgcacggcttgtagaccccgcgagaaggaaggtcgagccaggttaccaccaaagaatatgattttggtctaggggctccagtttctgaagctgaaaactaccagaatactctccagctagaacaagaagtgagaaaccaagatagattcatctcgacactgaaattacagattgaagatctcaaacagacaaatcatggcttggaagaatatgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagattgatctcatttgccagcaaaataatattatagtattggaagatacaataaaaaggcttaaatctacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaagagaatctttgctacagagatttctgacacctgaaatgattcttcacatccctgagaaaggtcaaagttacaaactgatttttttttttttgctacatgagtgcatttatcttttaaatgcttggcaatgttaaatgtatttattaactttgtgtctctgaatctctgttctaatgtgccatgttgcagtgatctgagatgacttataaaaacaaaaatgtatatggctctttctatccatgcagtgatagtgagtgtaaaatctgcttacttcactattgaacactattctgttcactatctggagtaaataaagaagcttattaaaacagggaaaagtgtttttacaaaactgctttcctttcctttcttggtatctcaaataattggttggttaattttttttctttgtgatttgtgttttcatggctggaaaatctgtgccaaaatgggtacaacttactgatactggtctgggatctgatattccattttggaaccaaccttacatgaattccatgccataatctgatattgaagcagcagaaagtaggagtgttgtcagggttttaaaacctatagtattgtaccactcaaagactaagtaacatacatattctacaattgtgtttactactactgcttttagaaaggtaggtgatggtatatctgtcaagaatgtaagattttattaaaaatctttatttttaataagttttctttcaagtactgcaatcaacttaattgcgattttattttattgtctgtggcagctgtctgtaatctggagtaataagataagtgatgtttccttcctcccccaatttcctaaatctcttaccttatctatccataggctttgatgtaatgttcatattagagcctgaatgctactgtattttactgatataaactatttgtattcttgccattttaataaaaaaaggcttgtcattaatagtatt

SEQ ID NO: 286070 - DNA, 3794 bp, Homo sapiens
tgcgcgcgatgctgccccgccccctgagggccggccccctgaagcgcaagagaaggaggggcgcgcagggatcgcgcctagtctctccgcctgcggagccgtggggtcccggcagcccgcaggagtgctaagtaagggtccttcagggcgggaaccaggttccaggcagggacgcaggctacgttcgaataaaagtaccgaaggtcataaggccccagttcagatgggacttccccgcgtgacagcacagagataacggccagccctgggcgaaggttaccaccaaagaatatgattttggtctaggggctccagtttctgaagctgaaaactaccagaatactctccagctagaacaagaagtgagaaaccaagatagattcatctcgacactgaaattacagattgaagatctcaaacagacaaatcatggcttggaagaatatgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagattgatctcatttgccagcaaaataatattatagtattggaagatacaataaaaaggcttaaatctacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaagagaatctttgctacagagatttctgacacctgaaatgattcttcacatccctgagaaaggtcaaagttacaaactgatttttttttttttgctacatgagtgcatttatcttttaaatgcttggcaatgttaaatgtatttattaactttgtgtctctgaatctctgttctaatgtgccatgttgcagtgatctgagatgacttataaaaacaaaaatgtatatggctctttctatccatgcagtgatagtgagtgtaaaatctgcttacttcactattgaacactattctgttcactatctggagtaaataaagaagcttattaaaacagggaaaagtgtttttacaaaactgctttcctttcctttcttggtatctcaaataattggttggttaattttttttctttgtgatttgtgttttcatggctggaaaatctgtgccaaaatgggtacaacttactgatactggtctgggatctgatattccattttggaaccaaccttacatgaattccatgccataatctgatattgaagcagcagaaagtaggagtgttgtcagggttttaaaacctatagtattgtaccactcaaagactaagtaacatacatattctacaattgtgtttactactactgcttttagaaaggtaggtgatggtatatctgtcaagaatgtaagattttattaaaaatctttatttttaataagttttctttcaagtactgcaatcaacttaattgcgattttattttattgtctgtggcagctgtctgtaatctggagtaataagataagtgatgtttccttcctcccccaatttcctaaatctcttaccttatctatccataggctttgatgtaatgttcatattagagcctgaatgctactgtattttactgatataaactatttgtattcttgccattttaataaaaaaaggcttgtcattaatagtatt

SEQ ID NO: 286071 - DNA, 3666 bp, Homo sapiens
  misc_feature (2653)..(2653): n is a, c, g, or t
  misc_feature (2656)..(2656): n is a, c, g, or t
  misc_feature (2671)..(2671): n is a, c, g, or t
  misc_feature (2702)..(2702): n is a, c, g, or t
acgcgtgcgcaccgggcctgggggcgagcgggacggaagcaaagctggggcgccggggaggtggaagacgagccccactccggttaccaccaaagaatatgattttggtctaggggctccagtttctgaagctgaaaactaccagaatactctccagctagaacaagaagtgagaaaccaagatagattcatctcgacactgaaattacagattgaagatctcaaacagacaaatcatggcttggaagaatatgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagattgatctcatttgccagcaaaataatattatagtattggaagatacaataaaaaggcttaaatctacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaagaaggaaggaaaggacnacnaaatcttcttctttngggctcaccaaccggaagagggaaaattttntgaatctttgctacagagatttctgacacctgaaatgattcttcacatccctgagaaaggtcaaagttacaaactgatttttttttttttgctacatgagtgcatttatcttttaaatgcttggcaatgttaaatgtatttattaactttgtgtctctgaatctctgttctaatgtgccatgttgcagtgatctgagatgacttataaaaacaaaaatgtatatggctctttctatccatgcagtgatagtgagtgtaaaatctgcttacttcactattgaacactattctgttcactatctggagtaaataaagaagcttattaaaacagggaaaagtgtttttacaaaactgctttcctttcctttcttggtatctcaaataattggttggttaattttttttctttgtgatttgtgttttcatggctggaaaatctgtgccaaaatgggtacaacttactgatactggtctgggatctgatattccattttggaaccaaccttacatgaattccatgccataatctgatattgaagcagcagaaagtaggagtgttgtcagggttttaaaacctatagtattgtaccactcaaagactaagtaacatacatattctacaattgtgtttactactactgcttttagaaaggtaggtgatggtatatctgtcaagaatgtaagattttattaaaaatctttatttttaataagttttctttcaagtactgcaatcaacttaattgcgattttattttattgtctgtggcagctgtctgtaatctggagtaataagataagtgatgtttccttcctcccccaatttcctaaatctcttaccttatctatccataggctttgatgtaatgttcatattagagcctgaatgctactgtattttactgatataaactatttgtattcttgccattttaataaaaaaaggcttgtcattaatagtatt

SEQ ID NO: 286072 - DNA, 2907 bp, Homo sapiens
ttcataattctacattatatgtgtaatttattaatgttgggcaacaaataaattcttttgcaaacagcatatttatactatagtcaaattgaaccagattgaaaaatatagactgatatactgtgataagctttactttgcagtggcttttccttggtcctacttcacaacaccttatctgtaaaaccttctacagcagtcaggtctaacctgataatctcatcctgtcagtcttgccataaaccagtttgtacagagggagtatgcccttcaggaagattactaaggtgtttttagtgatggcagtaaccttgtcattctacttgtatagcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaagagaatctttgctacagagatttctgacacctgaaatgattcttcacatccctgagaaaggtcaaagttacaaactgatttttttttttttgctacatgagtgcatttatcttttaaatgcttggcaatgttaaatgtatttattaactttgtgtctctgaatctctgttctaatgtgccatgttgcagtgatctgagatgacttataaaaacaaaaatgtatatggctctttctatccatgcagtgatagtgagtgtaaaatctgcttacttcactattgaacactattctgttcactatctggagtaaataaagaagcttattaaaacagggaaaagtgtttttacaaaactgctttcctttcctttcttggtatctcaaataattggttggttaattttttttctttgtgatttgtgttttcatggctggaaaatctgtgccaaaatgggtacaacttactgatactggtctgggatctgatattccattttggaaccaaccttacatgaattccatgccataatctgatattgaagcagcagaaagtaggagtgttgtcagggttttaaaacctatagtattgtaccactcaaagactaagtaacatacatattctacaattgtgtttactactactgcttttagaaaggtaggtgatggtatatctgtcaagaatgtaagattttattaaaaatctttatttttaataagttttctttcaagtactgcaatcaacttaattgcgattttattttattgtctgtggcagctgtctgtaatctggagtaataagataagtgatgtttccttcctcccccaatttcctaaatctcttaccttatctatccataggctttgatgtaatgttcatattagagcctgaatgctactgtattttactgatataaactatttgtattcttgccattttaataaaaaaaggcttgtcattaatagtatt

SEQ ID NO: 286073 - DNA, 2559 bp, Homo sapiens
ttaaaacagaaatataaaagataatattgaaggagaactcacatttgggtattttaagtcccaataaagatctaaggtaagcagctgaatatttaagtttgtgtctcagaagagaaagatacatatttgggacacatcagcatataaatgatattttaaaaccgtgaaattacctagggaaatatagagaatgagaagaggatccaggactgagtaacaagaagccaaagaagtaggaagaagacccagaaataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaagagaatctttgctacagagatttctgacacctgaaatgattcttcacatccctgagaaaggtcaaagttacaaactgatttttttttttttgctacatgagtgcatttatcttttaaatgcttggcaatgttaaatgtatttattaactttgtgtctctgaatctctgttctaatgtgccatgttgcagtgatctgagatgacttataaaaacaaaaatgtatatggctctttctatccatgcagtgatagtgagtgtaaaatctgcttacttcactattgaacactattctgttcactatctggagtaaataaagaagcttattaaaacagggaaaagtgtttttacaaaactgctttcctttcctttcttggtatctcaaataattggttggttaattttttttctttgtgatttgtgttttcatggctggaaaatctgtgccaaaatgggtacaacttactgatactggtctgggatctgatattccattttggaaccaaccttacatgaattccatgccataatctgatattgaagcagcagaaagtaggagtgttgtcagggttttaaaacctatagtattgtaccactcaaagactaagtaacatacatattctacaattgtgtttactactactgcttttagaaaggtaggtgatggtatatctgtcaagaatgtaagattttattaaaaatctttatttttaataagttttctttcaagtactgcaatcaacttaattgcgattttattttattgtctgtggcagctgtctgtaatctggagtaataagataagtgatgtttccttcctcccccaatttcctaaatctcttaccttatctatccataggctttgatgtaatgttcatattagagcctgaatgctactgtattttactgatataaactatttgtattcttgccattttaataaaaaaaggcttgtcattaatagtatt

SEQ ID NO: 286074 - DNA, 2114 bp, Homo sapiens
gcctctcgggtagctgggactacaggcgcccgcaccacacctggctaattttttgtatttttagtagagacggggtttcaccgtgttagccaggatggtctcgatctcctgacctcgtgatccgcccgccttggcctcccaaagtgttgggattacaggcgtgacaaccacacccggccttaaacattcttagataaggtattcttctgtcttaacttgcctgttttataaagtctaacaatggcacatagtttgaagacaaattggcatttctggaccacttactagagaagttccaaattggcactacaggtttactgctattccgatcttaagtcataccaaggtgtaaaaattcagctccgactaattaaaatgaatattgaattatatttcattcagtggtttagtgcttcttccatcctgctcactggagacacaaatatgagtaaggcatacctctggccctgcctgttttatttatcatgacatgattttttatacctcacatagtattggatatacagtagttactcaataaacacttgttgatttgagtgtccttgagaaacttgttggctggtgggagagtttgacgtgtaaaaagattttttaaaattacaatgaaaaaatatataagaaaataaaatacataatagaagtcattaagagaaatcttaatcactaagaggaaggagtctcaaagcactccattggtttttgccttctctcatattgtctaattttaggaaagaatatcatcacccaaaattctgaggaaaaatgaaatgtgctctggtttaaatagttttcttatttttctttttatctaggattctcagatgttggttgtttctatgaaaccaggcagggaaattggaatgcattatgtttttaaaactttaaacctgcttctgttctgtttgactggcatttactattttctgcatttcattctctcacctaatctcttcctttctaatctgcttactaaaaatgaagatttaacatcagaagccgggctcagtaactgatcaaagggaactttaagatgcagtcttgtggcgcagtttgggctgctaacctgctatctaaaggtgatgcttcaaatggcttttctgtgcatgtgcatggattttgtgaatggtgaaaactgtctctaaactgtgtggtggtgtgtagtgtaaagtgaatttgttcttgatgggtgctatctcacaaaagatggacttgacaaaaggaccttaatttataataccatcctttgacaaatgtctctgataactaagtttttgctaaataacatttaagattaccaaaataacaatactcctggagtttcttaagaaatttaaaataggttgatctttgagacagctgctgcagtctagttctgataaaaggtaagggaagtcatgctaaatgcttctctgtcttcatagactttgattttagcatcctgtcttccattaagtttccctacttttttctggttcttgagtcaagatttcctctattaaagttttgcttctaatgattaggattacccatgatttaggccactaccaaattaaggaatcaattgccagtctagtcgtctcaaatcctatttggaacaaggtgggatataaaattttaaatgctaccatatctggtatcttctttccttaaataagggtttcccctctacatatgttataaactattctataattcctgttacatcatgtgttaacttgctgtgatttcatgttgaattaatacaaaactaactaatattaatttttcatgggaggtaagttttgtcagcttactgtttattattgtgtctgactcttaagtttagatctttatgagaattatgaacatgattaaatgttaaaaaattaagtatttgatttctaccctttgtttcctgccctccttttttcttcttttcttagtttgactatccaaagcatacacacactcacattcactctttattattagttaatagttatttggtcccttttctccttgatgtgaaatagtcacagctaatatttagttttatttttgctatttttaattcagttaaaactaatattgatgcaaccaaaactaaaaaaaaa

SEQ ID NO: 286075 - DNA, 513 bp, Homo sapiens
cgcgcgaggcgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaataggcgaagaattttaaggcgtggacagcaagatatcttcactgagatctgagatatctattgaaaaaccacaaaagaataacaggaaaaagcataagcactatactggttacttttagtacattaaaacaaaacaaaaatctttaaaaa

SEQ ID NO: 286076 - DNA, 2661 bp, Homo sapiens
cgcgcgaggcgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttctttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaacaaaaaaaaaaaaaacaacacaatacactcacaaaaacgctcgccccgaagcagcgaccgcgccccacacaacacccgcagaccaaaaacgcacacgagaccgaagcagaacaacaacaaagtagcgaccacgcgaaagctgacggaacacaaaaaaagagcgtgcgcgacatgcgccccgcaagagcaactacaacaacaatggtggtggcggccgagcaggcccaagcataaaagatagaagaccgactgcctgccgagacaaacgccggggccgacagatgagcggtgtaggccaccaacaagaaacaccgcgcgcccggctcatccagccaaacaacgggggg

SEQ ID NO: 286077 - DNA, 2080 bp, Homo sapiens
cgcgcgaggcgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttctttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttga

SEQ ID NO: 286078 - DNA, 3063 bp, Homo sapiens
cgcgcgaggcgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgaggtaagaaaatgttagtcatcaacttaagtatagaaatttataggagcgatcctaatacttctggctggaattagtattaaagggtaatgtatcaatatgctttattatttgaaattaacagttgctgaaatgtcaaaccatgcactaatgggaattttctgtttttccctttaacagtattggaatatgacagggaagatgaattcactatgagtttgtgacttaattattttgggggctgctatgttaaagtgtgttagtttaagaatactagttctgtctgtagctctaatcctctgagagcttgggtttctaaattattctgtgttgctcttgtaggttttgtttctgttgtttttggtttgttttgttgtactatcagcttttccccccttgtcttagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttctttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaacaaaaaaaaaaaaaacaacacaatacactcacaaaaacgctcgccccgaagcagcgaccgcgccccacacaacacccgcagaccaaaaacgcacacgagaccgaagcagaacaacaacaaagtagcgaccacgcgaaagctgacggaacacaaaaaaagagcgtgcgcgacatgcgccccgcaagagcaactacaacaacaatggtggtggcggccgagcaggcccaagcataaaagatagaagaccgactgcctgccgagacaaacgccggggccgacagatgagcggtgtaggccaccaacaagaaacaccgcgcgcccggctcatccagccaaacaacgggggg

SEQ ID NO: 286079 - DNA, 2502 bp, Homo sapiens
cgcgcgaggcgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttctttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaacaaaaaaaaaaaaaacaacacaatacactcacaaaaacgctcgccccgaagcagcgaccgcgccccacacaacacccgcagaccaaaaacgcacacgagaccgaagcagaacaacaacaaagtagcgaccacgcgaaagctgacggaacacaaaaaaagagcgtgcgcgacatgcgccccgcaagagcaactacaacaacaatggtggtggcggccgagcaggcccaagcataaaagatagaagaccgactgcctgccgagacaaacgccggggccgacagatgagcggtgtaggccaccaacaagaaacaccgcgcgcccggctcatccagccaaacaacgggggg

SEQ ID NO: 286080 - DNA, 3096 bp, Homo sapiens
cgcgcgaggcgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgaggtaagaaaatgttagtcatcaacttaagtatagaaatttataggagcgatcctaatacttctggctggaattagtattaaagggtaatgtatcaatatgctttattatttgaaattaacagttgctgaaatgtcaaaccatgcactaatgggaattttctgtttttccctttaacagtattggaatatgacagggaagatgaattcactatgagtttgtgacttaattattttgggggctgctatgttaaagtgtgttagtttaagaatactagttctgtctgtagctctaatcctctgagagcttgggtttctaaattattctgtgttgctcttgtaggttttgtttctgttgtttttggtttgttttgttgtactatcagcttttccccccttgtcttagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagattctcagatgttggttgtttctatgaaaccagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttctttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaacaaaaaaaaaaaaaacaacacaatacactcacaaaaacgctcgccccgaagcagcgaccgcgccccacacaacacccgcagaccaaaaacgcacacgagaccgaagcagaacaacaacaaagtagcgaccacgcgaaagctgacggaacacaaaaaaagagcgtgcgcgacatgcgccccgcaagagcaactacaacaacaatggtggtggcggccgagcaggcccaagcataaaagatagaagaccgactgcctgccgagacaaacgccggggccgacagatgagcggtgtaggccaccaacaagaaacaccgcgcgcccggctcatccagccaaacaacgggggg

SEQ ID NO: 286081 - DNA, 2694 bp, Homo sapiens
cgcgcgaggcgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagattctcagatgttggttgtttctatgaaaccagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttctttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaacaaaaaaaaaaaaaacaacacaatacactcacaaaaacgctcgccccgaagcagcgaccgcgccccacacaacacccgcagaccaaaaacgcacacgagaccgaagcagaacaacaacaaagtagcgaccacgcgaaagctgacggaacacaaaaaaagagcgtgcgcgacatgcgccccgcaagagcaactacaacaacaatggtggtggcggccgagcaggcccaagcataaaagatagaagaccgactgcctgccgagacaaacgccggggccgacagatgagcggtgtaggccaccaacaagaaacaccgcgcgcccggctcatccagccaaacaacgggggg

SEQ ID NO: 286082 - DNA, 3162 bp, Homo sapiens
gcctctcgggtagctgggactacaggcgcccgcaccacacctggctaattttttgtatttttagtagagacggggtttcaccgtgttagccaggatggtctcgatctcctgacctcgtgatccgcccgccttggcctcccaaagtgttgggattacaggcgtgacaaccacacccggccttaaacattcttagataaggtattcttctgtcttaacttgcctgttttataaagtctaacaatggcacatagtttgaagacaaattggcatttctggaccacttactagagaagttccaaattggcactacaggtttactgctattccgatcttaagtcataccaaggtgtaaaaattcagctccgactaattaaaatgaatattgaattatatttcattcagtggtttagtgcttcttccatcctgctcactggagacacaaatatgagtaaggcatacctctggccctgcctgttttatttatcatgacatgattttttatacctcacatagtattggatatacagtagttactcaataaacacttgttgatttgagtgtccttgagaaacttgttggctggtgggagagtttgacgtgtaaaaagattttttaaaattacaatgaaaaaatatataagaaaataaaatacataatagaagtcattaagagaaatcttaatcactaagaggaaggagtctcaaagcactccattggtttttgccttctctcatattgtctaattttaggaaagaatatcatcacccaaaattctgaggaaaaatgaaatgtgctctggtttaaatagttttcttatttttctttttatctaggattctcagatgttggttgtttctatgaaaccagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttctttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaacaaaaaaaaaaaaaacaacacaatacactcacaaaaacgctcgccccgaagcagcgaccgcgccccacacaacacccgcagaccaaaaacgcacacgagaccgaagcagaacaacaacaaagtagcgaccacgcgaaagctgacggaacacaaaaaaagagcgtgcgcgacatgcgccccgcaagagcaactacaacaacaatggtggtggcggccgagcaggcccaagcataaaagatagaagaccgactgcctgccgagacaaacgccggggccgacagatgagcggtgtaggccaccaacaagaaacaccgcgcgcccggctcatccagccaaacaacgggggg

SEQ ID NO: 286083 - DNA, 2602 bp, Homo sapiens
cgcgcgaggcgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatcaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttctttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaacaaaaaaaaaaaaaacaacacaatacactcacaaaaacgctcgccccgaagcagcgaccgcgccccacacaacacccgcagaccaaaaacgcacacgagaccgaagcagaacaacaacaaagtagcgaccacgcgaaagctgacggaacacaaaaaaagagcgtgcgcgacatgcgccccgcaagagcaactacaacaacaatggtggtggcggccgagcaggcccaagcataaaagatagaagaccgactgcctgccgagacaaacgccggggccgacagatgagcggtgtaggccaccaacaagaaacaccgcgcgcccggctcatccagccaaacaacgggggg

SEQ ID NO: 286084 - DNA, 2585 bp, Homo sapiens
ctcgtgccgattcggcaccaggttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatcaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttctttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaacaaaaaaaaaaaaaacaacacaatacactcacaaaaacgctcgccccgaagcagcgaccgcgccccacacaacacccgcagaccaaaaacgcacacgagaccgaagcagaacaacaacaaagtagcgaccacgcgaaagctgacggaacacaaaaaaagagcgtgcgcgacatgcgccccgcaagagcaactacaacaacaatggtggtggcggccgagcaggcccaagcataaaagatagaagaccgactgcctgccgagacaaacgccggggccgacagatgagcggtgtaggccaccaacaagaaacaccgcgcgcccggctcatccagccaaacaacgggggg

SEQ ID NO: 286085 - DNA, 2357 bp, Homo sapiens
cgcgcgaggcgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaataggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttctttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaacaaaaaaaaaaaaaacaacacaatacactcacaaaaacgctcgccccgaagcagcgaccgcgccccacacaacacccgcagaccaaaaacgcacacgagaccgaagcagaacaacaacaaagtagcgaccacgcgaaagctgacggaacacaaaaaaagagcgtgcgcgacatgcgccccgcaagagcaactacaacaacaatggtggtggcggccgagcaggcccaagcataaaagatagaagaccgactgcctgccgagacaaacgccggggccgacagatgagcggtgtaggccaccaacaagaaacaccgcgcgcccggctcatccagccaaacaacgggggg

SEQ ID NO: 286086 - DNA, 1464 bp, Homo sapiens
cgcgcgaggcgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggctggagtgcaatggcgcgatgatgggagtccatagcgatgatgggagtccatagcgatgatgggagtccatggcgatgatgggagtccatagcgatgatgggagtccatagcgatgatgggagtccatagcgatgatgggagtccatagcgatgatgggagtccata

SEQ ID NO: 286087 - DNA, 1695 bp, Homo sapiens
cgcgcgaggcgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcacctttgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaacaaaaaaaaaaaaaacaacacaatacactcacaaaaacgctcgccccgaagcagcgaccgcgccccacacaacacccgcagaccaaaaacgcacacgagaccgaagcagaacaacaacaaagtagcgaccacgcgaaagctgacggaacacaaaaaaagagcgtgcgcgacatgcgccccgcaagagcaactacaacaacaatggtggtggcggccgagcaggcccaagcataaaagatagaagaccgactgcctgccgagacaaacgccggggccgacagatgagcggtgtaggccaccaacaagaaacaccgcgcgcccggctcatccagccaaacaacgggggg

SEQ ID NO: 286088 - DNA, 1322 bp, Homo sapiens
agctgggcgcggtagctcacttctgtaatcccagcactttgggaggccgaggcaggcggatcacgaggtcaggagatcgagaccatccctggctaacacggtgaaaccctgtctctactaaaaatacaaaaaattatagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaacaaaaaaaaaaaaaacaacacaatacactcacaaaaacgctcgccccgaagcagcgaccgcgccccacacaacacccgcagaccaaaaacgcacacgagaccgaagcagaacaacaacaaagtagcgaccacgcgaaagctgacggaacacaaaaaaagagcgtgcgcgacatgcgccccgcaagagcaactacaacaacaatggtggtggcggccgagcaggcccaagcataaaagatagaagaccgactgcctgccgagacaaacgccggggccgacagatgagcggtgtaggccaccaacaagaaacaccgcgcgcccggctcatccagccaaacaacgggggg

SEQ ID NO: 286089 - DNA, 1475 bp, Homo sapiens
ccaaggtacagtggtatttcttactttgggattctgctccctccatgaggtatctaaaatgttgatgaattgctaatacctggatttcccaggagtgtaactaacattatctgggaagaatgaatctgaatcagcttctccttggaatccagcatcctagtcccagcgcttgggaatactacttttccagccatggtctttcttgagttgctgttaccagtgaaaccttgggctgcccccaggtgtgtttagcccagaggagaggactttcttgccctttctttccatcttttagctccttatcatatactggttcagttgtacccttttaccttacccatttctactatcatggaggttcagaattcacatctgaattcaaaagataattgggagccaggcatggtggtgtgtgcttaataatcccagttacccaggagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaacaaaaaaaaaaaaaacaacacaatacactcacaaaaacgctcgccccgaagcagcgaccgcgccccacacaacacccgcagaccaaaaacgcacacgagaccgaagcagaacaacaacaaagtagcgaccacgcgaaagctgacggaacacaaaaaaagagcgtgcgcgacatgcgccccgcaagagcaactacaacaacaatggtggtggcggccgagcaggcccaagcataaaagatagaagaccgactgcctgccgagacaaacgccggggccgacagatgagcggtgtaggccaccaacaagaaacaccgcgcgcccggctcatccagccaaacaacgggggg

SEQ ID NO: 286090 - DNA, 890 bp, Homo sapiens
cgcgcgaggcgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaagcaagcagacagatctgggaatcactgaggatgctctggggaagcatgctgagctcaagacaattctcttccaggcgaagaattttaaggcgtggacagcaagatatcttcactgagatctgagatatctattgaaaaaccacaaaagaataacaggaaaaagcataagcactatactggttacttttagtacattaaaacaaaacaaaaatctttaaaaa

SEQ ID NO: 286091 - DNA, 2048 bp, Homo sapiens
cgcgcgaggcgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgaggtaagaaaatgttagtcatcaacttaagtatagaaatttataggagcgatcctaatacttctggctggaattagtattaaagggtaatgtatcaatatgctttattatttgaaattaacagttgctgaaatgtcaaaccatgcactaatgggaattttctgtttttccctttaacagtattggaatatgacagggaagatgaattcactatgagtttgtgacttaattattttgggggctgctatgttaaagtgtgttagtttaagaatactagttctgtctgtagctctaatcctctgagagcttgggtttctaaattattctgtgttgctcttgtaggttttgtttctgttgtttttggtttgttttgttgtactatcagcttttccccccttgtcttagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagattctcagatgttggttgtttctatgaaaccaggcagggaaattggaatgcattatgtttttaaaactttaaacctgcttctgttctgtttgactggcatttactattttctgcatttcattctctcacctaatctcttcctttctaatctgcttactaaaaatgaagatttaacatcagaagccgggctcagtaactgatcaaagggaactttaagatgcagtcttgtggcgcagtttgggctgctaacctgctatctaaaggtgatgcttcaaatggcttttctgtgcatgtgcatggattttgtgaatggtgaaaactgtctctaaactgtgtggtggtgtgtagtgtaaagtgaatttgttcttgatgggtgctatctcacaaaagatggacttgacaaaaggaccttaatttataataccatcctttgacaaatgtctctgataactaagtttttgctaaataacatttaagattaccaaaataacaatactcctggagtttcttaagaaatttaaaataggttgatctttgagacagctgctgcagtctagttctgataaaaggtaagggaagtcatgctaaatgcttctctgtcttcatagactttgattttagcatcctgtcttccattaagtttccctacttttttctggttcttgagtcaagatttcctctattaaagttttgcttctaatgattaggattacccatgatttaggccactaccaaattaaggaatcaattgccagtctagtcgtctcaaatcctatttggaacaaggtgggatataaaattttaaatgctaccatatctggtatcttctttccttaaataagggtttcccctctacatatgttataaactattctataattcctgttacatcatgtgttaacttgctgtgatttcatgttgaattaatacaaaactaactaatattaatttttcatgggaggtaagttttgtcagcttactgtttattattgtgtctgactcttaagtttagatctttatgagaattatgaacatgattaaatgttaaaaaattaagtatttgatttctaccctttgtttcctgccctccttttttcttcttttcttagtttgactatccaaagcatacacacactcacattcactctttattattagttaatagttatttggtcccttttctccttgatgtgaaatagtcacagctaatatttagttttatttttgctatttttaattcagttaaaactaatattgatgcaaccaaaactaaaaaaaaa

SEQ ID NO: 286092 - DNA, 695 bp, Homo sapiens
  misc_feature (695)..(695): n is a, c, g, or t
cgcgcgaggcgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatcggttatattgcccatgccgggcaaagaaactaatggccggtaaaggttctn

SEQ ID NO: 286093 - DNA, 586 bp, Homo sapiens
cgcgcgaggcgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagcaagcagacagatctgggaatcactgaggatgctctggggaagcatgctgagctcaagacaattctcttccaggcgaagaattttaaggcgtggacagcaagatatcttcactgagatctgagatatctattgaaaaaccacaaaagaataacaggaaaaagcataagcactatactggttacttttagtacattaaaacaaaacaaaaatctttaaaaa

SEQ ID NO: 286094 - DNA, 380 bp, Homo sapiens
cctcaggtcatcgcccacctcggcctcccaaagtgctgggatcacaggcgtgagccaccatacccagccatatacaagctttttagaacaaatttttccacagcaagaggctaggtgcctccggatcagtacgtgaaagattgttatcatgttgaatcgcttctaataccttttgacactgacatactcactgtggggagttattggtagattcaaggttgaagtttgctgttccataataatagcattttctggttgacactgtgaatggaacacaaagtgttaacttcacaacttattcttagaacaactaaaccgcatagaagaaggcttggaccaaataaataaggacatgagagagacagagaagactttaacag

SEQ ID NO: 286095 - DNA, 1944 bp, Homo sapiens
gagttccacatctgatacccaggagtctccagcttccaagagaggtcgggtcacagccagcagctatgtctgacataaatcttgactgggttgacaggcgtcagttgcagcgcttggaggaaatgctgattgttgtggatgagaatgataaggttattggtgccgacaccaagaggaattgccatctgaacgaaaacattgagaaagggctgctgcaccgagccttcagcgttgtcttgtttaacaccaagaatcgaatcctgatacagcagaggtcggacacgaaagtcacgtttcctgggtattttaccgactcctgtagtagccacccattatacaacccagcagaactggaagaaaaggatgccatcggagtgaggagggcagcccagaggcgtctgcaagcagagctgggaattcctggggaacagatttctccagaggacattgtgttcatgacaatctatcaccacaaggcaaaatcagacagaatttggggagagcatgaaatttgttaccttctgcttgtgaggaaaaacgtcactctgaacccggatcccagtgaaacgaaaagcatcctctacctgtcccaggaggagctgtgggagctgctggagagggaggcgaggggtgaagtcaaagtcaccccctggctaagaaccattgccgagaggtttctgtaccggtggtggcctcacctggatgacgtgaccccgtttgtggagcttcacaaaatacacagagtgtgagaggcagggaggtcgagtcagccatgtgtaatgccctcagtgcaggcagacgcaccattgaggcaatgatacaccctctccaaaaaacagggcaaaaggggcacttgattgcccatcatgtataaatcactatttcaaccttttcatcaactttgtcatatcttcattttcccttttccttatttccatatttctcatctgcctggttgcagggaggaaatttaacatttcctttgtcccaatttccattttataagcacttgtttgattaacagcagctgatcctgaaagtcttggggagatcttgagagtcctgaagcaggcagactagcctggctggaccatgaggctgtctccccacagctttatccaagcctccaaggtcaggatgggatctctgtatcatgtttttctttttaaatcacttatttcagagtgcaacacaaggctgcatttttaaaaaaaaagacacattcaatcttgcatcctaatacaagcagtacggaagatgcgtatgatctcagccaagtgactcgacgtttatccacttctgttcatttgatcgtttcagtaatatgcttacaaataaagacatacttgctttaaaacatactgttgttgtttaacacaaagtaaactatatgttaagttttggtgtttaatacagagaaagaatttcaaaaaccagacctggtattttttttttttttttcacacggagtctctctctgtcacccaggctggagtgcagtggcacgatctcggctcactgcaacctccgcctctgggctcaagcaattctcctgccttagcctcccgagcagctaggattacagatgcccaccaccacgcatggctaatttttgtatttttagtagagatggggtttcaccatgttggccaggctggtctcgaactcctgacctcctgatctgcccacctcggcctcccaaagtgctggaactacaggcttgagcccctgcgcccagcccagccctggtaaatttttaaaattgccacatgtaatccagaagtgtgattaactaaagtcctttcctcagctataatgttgattgtgtgacttgataacttatccgtggtggctcttggacccctgtgtgtctttggagctccaggagcacacggacccctgggcaggtccctccgaccccacagctcttcaccccaacgctcc

SEQ ID NO: 286096 - DNA, 1353 bp, Homo sapiens
gagttccacatctgatacccaggagtctccagcttccaagagaggtcgggtcacagccagcagctatgtctgacataaatcttgactgggttgacaggcgtcagttgcagcgcttggaggaaatgctgattgttgtggatgagaatgataaggttattggtgccgacaccaagaggaattgccatctgaacgaaaacattgagaaagggctgctgcaccgagccttcagcgttgtcttgtttaacaccaagaatcgaatcctgatacagcagaggtcggacacgaaagtcacgtttcctgggtattttaccgactcctgtagtagccacccattatacaacccagcagaactggaagaaaaggatgccatcggagtgaggagggcagcccagaggcgtctgcaagcagagctgggaattcctggggaacagatttctccagaggacattgtgttcatgacaatctatcaccacaaggcaaaatcagacagaatttggggagagcatgaaatttgttaccttctgcttgtgaggaaaaacgtcactctgaacccggatcccagtgaaacgaaaagcatcctctacctgtcccaggaggagctgtgggagctgctggagagggaggcgaggggtgaagtcaaagtcaccccctggctaagaaccattgccgagaggtttctgtaccggtggtggcctcacctggatgacgtgaccccgtttgtggagcttcacaaaatacacagagtgtgagaggcagggaggtcgagtcagccatgtgtaatgccctcagtgcaggcagacgcaccattgaggcaatgatacaccctctccaaaaaacagggcaaaaggggcacttgattgcccatcatgtataaatcactatttcaaccttttcatcaactttgtcatatcttcattttcccttttccttatttccatatttctcatctgcctggttgcagggaggaaatttaacatttcctttgtcccaatttccattttataagcacttgtttgattaacagcagctgatcctgaaagtcttggggagatcttgagagtcctgaagcaggcagactagcctggctggaccatgaggctgtctccccacagctttatccaagcctccaaggtcaggatgggatctctgtatcatgtttttctttttaaatcacttatttcagagtgcaacacaaggctgcatttttaaaaaaaaagacacattcaatcttgcatcctaatacaagcagtacggaagatgcgtatgatctcagccaagtgactcgacgtttatccacttctgttcatttgatcgtttcagtaatatgcttacaaataaagacatacttgcttt

SEQ ID NO: 286097 - DNA, 1668 bp, Homo sapiens
tttttttttatcagcagttccatccttgagttgctgctctatgcttgcatgtgttcattttctgaggaaaacaaatgtgtttattttctctatttttctgtaaattctgtgttttacattagcgttgttaacactgcaccaatttctgtcaatagatttctccagaggacattgtgttcatgacaatctatcaccacaaggcaaaatcagacagaatttggggagagcatgaaatttgttaccttctgcttgtgaggaaaaacgtcactctgaacccggatcccagtgaaacgaaaagcatcctctacctgtcccaggaggagctgtgggagctgctggagagggaggcgaggggtgaagtcaaagtcaccccctggctaagaaccattgccgagaggtttctgtaccggtggtggcctcacctggatgacgtgaccccgtttgtggagcttcacaaaatacacagagtgtgagaggcagggaggtcgagtcagccatgtgtaatgccctcagtgcaggcagacgcaccattgaggcaatgatacaccctctccaaaaaacagggcaaaaggggcacttgattgcccatcatgtataaatcactatttcaaccttttcatcaactttgtcatatcttcattttcccttttccttatttccatatttctcatctgcctggttgcagggaggaaatttaacatttcctttgtcccaatttccattttataagcacttgtttgattaacagcagctgatcctgaaagtcttggggagatcttgagagtcctgaagcaggcagactagcctggctggaccatgaggctgtctccccacagctttatccaagcctccaaggtcaggatgggatctctgtatcatgtttttctttttaaatcacttatttcagagtgcaacacaaggctgcatttttaaaaaaaaagacacattcaatcttgcatcctaatacaagcagtacggaagatgcgtatgatctcagccaagtgactcgacgtttatccacttctgttcatttgatcgtttcagtaatatgcttacaaataaagacatacttgctttaaaacatactgttgttgtttaacacaaagtaaactatatgttaagttttggtgtttaatacagagaaagaatttcaaaaaccagacctggtattttttttttttttttcacacggagtctctctctgtcacccaggctggagtgcagtggcacgatctcggctcactgcaacctccgcctctgggctcaagcaattctcctgccttagcctcccgagcagctaggattacagatgcccaccaccacgcatggctaatttttgtatttttagtagagatggggtttcaccatgttggccaggctggtctcgaactcctgacctcctgatctgcccacctcggcctcccaaagtgctggaactacaggcttgagcccctgcgcccagcccagccctggtaaatttttaaaattgccacatgtaatccagaagtgtgattaactaaagtcctttcctcagctataatgttgattgtgtgacttgataacttatccgtggtggctcttggacccctgtgtgtctttggagctccaggagcacacggacccctgggcaggtccctccgaccccacagctcttcaccccaacgctcc

SEQ ID NO: 286098 - DNA, 1077 bp, Homo sapiens
tttttttttatcagcagttccatccttgagttgctgctctatgcttgcatgtgttcattttctgaggaaaacaaatgtgtttattttctctatttttctgtaaattctgtgttttacattagcgttgttaacactgcaccaatttctgtcaatagatttctccagaggacattgtgttcatgacaatctatcaccacaaggcaaaatcagacagaatttggggagagcatgaaatttgttaccttctgcttgtgaggaaaaacgtcactctgaacccggatcccagtgaaacgaaaagcatcctctacctgtcccaggaggagctgtgggagctgctggagagggaggcgaggggtgaagtcaaagtcaccccctggctaagaaccattgccgagaggtttctgtaccggtggtggcctcacctggatgacgtgaccccgtttgtggagcttcacaaaatacacagagtgtgagaggcagggaggtcgagtcagccatgtgtaatgccctcagtgcaggcagacgcaccattgaggcaatgatacaccctctccaaaaaacagggcaaaaggggcacttgattgcccatcatgtataaatcactatttcaaccttttcatcaactttgtcatatcttcattttcccttttccttatttccatatttctcatctgcctggttgcagggaggaaatttaacatttcctttgtcccaatttccattttataagcacttgtttgattaacagcagctgatcctgaaagtcttggggagatcttgagagtcctgaagcaggcagactagcctggctggaccatgaggctgtctccccacagctttatccaagcctccaaggtcaggatgggatctctgtatcatgtttttctttttaaatcacttatttcagagtgcaacacaaggctgcatttttaaaaaaaaagacacattcaatcttgcatcctaatacaagcagtacggaagatgcgtatgatctcagccaagtgactcgacgtttatccacttctgttcatttgatcgtttcagtaatatgcttacaaataaagacatacttgcttt

SEQ ID NO: 286099 - DNA, 2101 bp, Homo sapiens
cccaagatttcccgttcagagagacaccacattagaaacagatgattcaccttccatatctcagaactgtgctgcttcaacacaattgctgtcacttgtagagaaggtgtatgctaaatcctaatgtggttggtaacacatagcaaaaacgagatggcaatatctttcacataaagaggcatttgtgtgcatctatttcaggtcgggtcacagccagcagctatgtctgacataaatcttgactgggttgacaggcgtcagttgcagcgcttggaggaaatgctgattgttgtggatgagaatgataaggttattggtgccgacaccaagaggaattgccatctgaacgaaaacattgagaaagggctgctgcaccgagccttcagcgttgtcttgtttaacaccaagaatcgaatcctgatacagcagaggtcggacacgaaagtcacgtttcctgggtattttaccgactcctgtagtagccacccattatacaacccagcagaactggaagaaaaggatgccatcggagtgaggagggcagcccagaggcgtctgcaagcagagctgggaattcctggggaacagatttctccagaggacattgtgttcatgacaatctatcaccacaaggcaaaatcagacagaatttggggagagcatgaaatttgttaccttctgcttgtgaggaaaaacgtcactctgaacccggatcccagtgaaacgaaaagcatcctctacctgtcccaggaggagctgtgggagctgctggagagggaggcgaggggtgaagtcaaagtcaccccctggctaagaaccattgccgagaggtttctgtaccggtggtggcctcacctggatgacgtgaccccgtttgtggagcttcacaaaatacacagagtgtgagaggcagggaggtcgagtcagccatgtgtaatgccctcagtgcaggcagacgcaccattgaggcaatgatacaccctctccaaaaaacagggcaaaaggggcacttgattgcccatcatgtataaatcactatttcaaccttttcatcaactttgtcatatcttcattttcccttttccttatttccatatttctcatctgcctggttgcagggaggaaatttaacatttcctttgtcccaatttccattttataagcacttgtttgattaacagcagctgatcctgaaagtcttggggagatcttgagagtcctgaagcaggcagactagcctggctggaccatgaggctgtctccccacagctttatccaagcctccaaggtcaggatgggatctctgtatcatgtttttctttttaaatcacttatttcagagtgcaacacaaggctgcatttttaaaaaaaaagacacattcaatcttgcatcctaatacaagcagtacggaagatgcgtatgatctcagccaagtgactcgacgtttatccacttctgttcatttgatcgtttcagtaatatgcttacaaataaagacatacttgctttaaaacatactgttgttgtttaacacaaagtaaactatatgttaagttttggtgtttaatacagagaaagaatttcaaaaaccagacctggtattttttttttttttttcacacggagtctctctctgtcacccaggctggagtgcagtggcacgatctcggctcactgcaacctccgcctctgggctcaagcaattctcctgccttagcctcccgagcagctaggattacagatgcccaccaccacgcatggctaatttttgtatttttagtagagatggggtttcaccatgttggccaggctggtctcgaactcctgacctcctgatctgcccacctcggcctcccaaagtgctggaactacaggcttgagcccctgcgcccagcccagccctggtaaatttttaaaattgccacatgtaatccagaagtgtgattaactaaagtcctttcctcagctataatgttgattgtgtgacttgataacttatccgtggtggctcttggacccctgtgtgtctttggagctccaggagcacacggacccctgggcaggtccctccgaccccacagctcttcaccccaacgctcc

SEQ ID NO: 286100 - DNA, 394 bp, Homo sapiens
cccaagatttcccgttcagagagacaccacattagaaacagatgattcaccttccatatctcagaactgtgctgcttcaacacaattgctgtcacttgtagagaaggtgtatgctaaatcctaatgtggttggtaacacatagcaaaaacgagatggcaatatctttcacataaagaggcatttgtgtgcatctatttcaggtcgggtcacagccagcagctatgtctgacataaatcttgactgggttgacaggcgtcagttgcagcgcttggaggaaatgctgattgttgtggatgagaatgataaggttattggtgccgacaccaagaggaactggacagagaatatgggcgggggctacctttctctatatctttcgtctcagatgcact

SEQ ID NO: 286101 - DNA, 139 bp, Homo sapiens
cttggaggaaatgctgattgttgtggatgagaatgataaggttattggtgccgacaccaagaggaattgccatctgaacgaaaacattgagaaaggtagcccccgcccattttctctgtccagttcccagggttttccc

SEQ ID NO: 286102 - DNA, 3237 bp, Homo sapiens
ggcctgagttcggggccagcagccgtctacccggtgtcgcgttctgtgttgtggcggccctggatccggcgtcagggcgaccgggcggacgaggtggagccagagtctgtcaggcgggttggtgaagggcgcggggccgggcacggcgttgggagtgcgcggcagggaccggccaggcgggctgcaggcacctcagagcccgggacaccccctcaacgtccgcaggcgcgatgaaggcactgatcttagtggggggctatgggacgcggctacggccgctgacgctgagcaccccgaagccactggtggacttctgcaataagcccatcttgctgcaccaagtggaggcgctagccgcggcaggcgtggaccacgtgatcctggccgtgagctacatgtcgcaggtgctggagaaggaaatgaaggcacaggagcagaggctgggaatccgaatctccatgtcccatgaagaggagcctttggggacagctgggcccctggcgctggcccgtgacctactctctgagactgcagaccctttcttcgtcctcaacagtgacgtgatctgcgatttccccttccaagccatggtgcagttccaccggcaccatggccaggagggctccatcctggtgaccaaggtggaggaaccctccaagtacggtgtggtggtgtgtgaggctgacacaggccgcattcaccggttcgtggagaagccacaggtgtttgtgtccaataagatcaacgcaggcatgtacatcctgagccctgcagtgctgcggcgcatccagctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtaagcctgtgggctgggctgggtggggagaggggcggggagtgtgcctgcctccctgacaaggcctatcctctcctggaggtacgcatggagaacgtgacagtgctgggtgaggacgtcatagttaatgatgagctctacctcaacggagccagcgtgctgccccacaagtctattggcgagtcagtgccagagcctcgtatcatcatgtgaggggatgcagtggggctggccgagccccggttttcccatcagcaaggggagtgctggcctgacacatcagaagaccctggacttgtcattatttgtctggggggcactgggtgaagctgaagctgttggacacctgccttctcatgtggacatcatctggcaggatccctgctgggcacaccccacaaaccccactccctcaagaagggccagggccagggctgtatggaataataatttaatgctcactgtggccctgactgaaagtcaagctcaggcacaattagggccatggctgggctcccaccaatgaggatacaggcaggcaaggaggttggatgtggtggtgtgggatacaggagaagggcaaagggagctcataaatagggcccagcctggctctgggttcaaaggtggaggttccaggatggcacaggctgtgagggctaggcagctgaggaggtagtactcgtattggctcccttctcccagtcctctacagacacgatggtggttttgcagaagaagcagtccttgttgttcatcaggtgctggttgatacaggctctacaacaggggaggggatgaggactgccctgcatgtacctactgctctccccaccaccaagctgtggggcccacttacttgcaggacttgtggccacagggctggaacacagcagagatggggtgggcatagcagatggggcagaggtcctcctcactggtgggctgcagggaggagagtgaagggtgggctggagttggatgcctggctatgtggatgtccgttgtgcctgtgtaggagtgcacacatattcaagtggcatggacctgtgcaccgtgttcccactcaccagggaggcagctgctgcctgggcagatgcagaggtcaggtgcgccagcatctgttccacttgggccagctcatcggcactgatataatccgcatctggggagtggtaggtagtgtcaagtcagaggtagctgaggatgtgatgcctcttgaatattcccagcctaggactttgctgttcttaaggctcctgacccgacccagccccagatttccctgacctgccccaccagcccactcacagctctgcagggagaagcgcttccggtcaggggctggcagagcagtgccaggtgctgggggctctggctgtcccaggagatagcatattgagcgtagctggaagcagggatctgccaggagcactgatgtggcttgctctctcctaggtaggggagggtgcaagggcagtcagaaggcttggggcctggctaaaagtctctcttgggattgccaatgaggagtgccatggctcgtacatgatcaccccccctgcatcctttccgtctccctgcttcccaaaccccaagtcctgtattctagtaaggtgccacacagcctgtttttttttttttttttcttgagacgagtctcgctctgttgcccaggctggagtgcgatggcacgatctcggctcactgcaacctccacctcccgggttcaagtgattctcctgctttagcctcccgagtagctggaattgcagacgcccaccaccacgcccggctaattgttgttgtatttttagtagagacagggtttcaccaggttggccaggctggtctcgaattcctgacctcaggtgatccacctgccttggcttcccaaagtgctgggattacaggcgtgagccaccgcgcccggcctggggtaccactttaagaaggctcaggcgaaccaccttaagatagtgagagtctgcctgccccataatattatcagtccttcaaagtcacttcaaataaacactaacagcagcttggagac

SEQ ID NO: 286103 - DNA, 6131 bp, Homo sapiens
  misc_feature (5424)..(5424): n is a, c, g, or t
ggcctgagttcggggccagcagccgtctacccggtgtcgcgttctgtgttgtggcggccctggatccggcgtcagggcgaccgggcggacgaggtggagccagagtctgtcaggcgggcgcgatgaaggcactgatcttagtggggggctatgggacgcggctacggccgctgacgctgagcaccccgaagccactggtggacttctgcaataagcccatcttgctgcaccaagtggaggcgctagccgcggcaggcgtggaccacgtgatcctggccgtgagctacatgtcgcaggtgctggagaaggaaatgaaggcacaggagcagaggctgggaatccgaatctccatgtcccatgaagaggagcctttggggacagctgggcccctggcgctggcccgtgacctactctctgagactgcagaccctttcttcgtcctcaacagtgacgtgatctgcgatttccccttccaagccatggtgcagttccaccggcaccatggccaggagggctccatcctggtgaccaaggtggaggaaccctccaagtacggtgtggtggtgtgtgaggctgacacaggccgcattcaccggttcgtggagaagccacaggtgtttgtgtccaataagatcaacgcaggcatgtacatcctgagccctgcagtgctgcggcgcatccagctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtacgcatggagaacgtgacagtgctgggtgaggacgtcatagttaatgatgagctctacctcaacggagccagcgtgctgccccacaagtctattggcgagtcagtgccagagcctcgtatcatcatgtgaggggatgcagtggggctggccgagccccggttttcccatcagcaaggggagtgctggcctgacacatcagaagaccctggacttgtcattatttgtctggggggcactgggtgaagctgaagctgttggacacctgccttctcatgtggacatcatctggcaggatccctgctgggcacaccccacaaaccccactccctcaagaagggccagggccagggctgtatggaataataatttaatgctcactgtggccctgactgaaagtcaagctcaggcacaattagggccatggctgggctcccaccaatgaggatacaggcaggcaaggaggttggatgtggtggtgtgggatacaggagaagggcaaagggagctcataaatagggcccagcctggctctgggttcaaaggtggaggttccaggatggcacaggctgtgagggctaggcagctgaggaggtagtactcgtattggctcccttctcccagtcctctacagacacgatggtggttttgcagaagaagcagtccttgttgttcatcaggtgctggttgatacaggctctacaacaggggaggggatgaggactgccctgcatgtacctactgctctccccaccaccaagctgtggggcccacttacttgcaggacttgtggccacagggctggaacacagcagagatggggtgggcatagcagatggggcagaggtcctcctcactggtgggctgcagggaggagagtgaagggtgggctggagttggatgcctggctatgtggatgtccgttgtgcctgtgtaggagtgcacacatattcaagtggcatggacctgtgcaccgtgttcccactcaccagggaggcagctgctgcctgggcagatgcagaggtcaggtgcgccagcatctgttccacttgggccagctcatcggcactgatataatccgcatctggggagtggtaggtagtgtcaagtcagaggtagctgaggatgtgatgcctcttgaatattcccagcctaggactttgctgttcttaaggctcctgacccgacccagccccagatttccctgacctgccccaccagcccactcacagctctgcagggagaagcgcttccggtcaggggctggcagagcagtgccaggtgctgggggctctggctgtcccaggagatagcatattgagcgtagctggaagcagggatctgccaggagcactgatgtggcttgctctctcctaggtaggggagggtgcaagggcagtcagaaggcttggggcctggctaaaagtctctcttgggattgccaatgaggagtgccatggctcgtacatgatcaccccccctgcatcctttccgtctccctgcttcccaaaccccaagtcctgtattctagtaaggtgccacacagcctgtttttttttttttttttcttgagacgagtctcgctctgttgcccaggctggagtgcgatggcacgatctcggctcactgcaacctccacctcccgggttcaagtgattctcctgctttagcctcccgagtagctggaattgcagacgcccaccaccacgcccggctaattgttgttgtatttttagtagagacagggtttcaccaggttggccaggctggtctcgaattcctgacctcaggtgatccacctgccttggcttcccaaagtgctgggattacaggcgtgagccaccgcgcccggcctggggtaccactttaagaaggctcaggcgaaccaccttaagatagtgagagtctgcctgccccataatattatcagtccttcaaagtcacttcaaataaacactaacagcagcttggagacattcttccagactcccccttttactccccgaggaaaaacgagcggcggagagctgccagccaaaggctgacggggactttggggttggccttgctccccatctggcggtcatgcggggccattgggcacaaagggatgtagccgccccgcctcctcaaacgggaaccaataggagcccgggccccgcccctggggggagtatttaggagccgatcaggaactcgcttggagagggctagcgaagccgaagggagcgcggctaagagtgccgcaccgcctcacaacctgggaaccggagagtaggggccgtcggctggcaagaacccgccgtgcctcctcggcaagggccatccggtgccacccatgtcgcactagagcagaagagggtgagtcctggaactgcaacctgcacagagctgctctgtactgtccctggtggtcgccgccatgacctggttggtgctgctggggacactgctctgcatgctgcgcgttgggttaggcaccccggactccgagggtttcccgccccgtgcgctccacaactgcccctacaaatgtatctgcgctgccgacctgctaagctgcactggcctagggctgcaggacgtgccagccgagttacctgccgctactgcggacctcgacctgagccacaacgcgctccagcgcctgcgccccggctggttggcgcccctcttccagctgcgcgccctgcacctagaccacaacgaactagatgcgctgggtcgcggcgtcttcgtcaacgccagcggcctgaggctgctcgatctatcatctaacacgttgcgggcgcttggccgccacgacctcgacgggctgggggcgctggagaagctgcttctgttcaataaccgcttggtgcacttggacgagcatgccttccacggcctgcgcgcgctcagccatctctacctgggctgcaacgaactcgcctcgttctccttcgaccacctgcacggtctgagcgccacccacctgcttactctggacctctcctccaaccggctgggacacatctccgtacctgagctggccgcgctgccggccttcctcaagaacggcctctacttgcacaacaaccctttgccttgcgactgccgcctctaccacctgctacagcgctggcaccagcggggcctgagcgccgtgcgcgactttgcgcgcgagtacgtatgcttggccttcaaggtacccgcgtcccgcgtgcgcttcttccagcacagccgcgtctttgagaactgctcgtcggccccagctcttggcctagagcggccggaagagcacctgtacgcgctggtgggtcggtccctgaggctttactgcaacaccagcgtcccggccatgcgcattgcctgggtttcgccgcagcaggagcttctcagggcgccaggatcccgcgatggcagcatcgcggtgctggccgacggcagcttggccataggcaacgtacaggagcagcatgcgggactcttcgtgtgcctggccactgggccccgcctgcaccacaaccagacgcacgagtacaacgtgagcgtgcactttccgcgcccagagcccgaggctttcaacacaggcttcaccacactgctgggctgtgccgtgggccttgtgctcgtgctgctctacctgttcgccccaccctgccgctgctgccgccgtgcctgccgctgccgccgctggccccaaacacccagcccgctccaagagctgagcgcacagtcctcagtactcagcaccacaccgccagacgcacccagccgcaaggccagcgtccacaagcacgtagtctttctggagccaggccggaggggcctcaatggccgcgtgcagctggcagtagctgaggaattcgatctctacaaccctggaggcctgcagctgaaggctggctctgagtccgccagctccataggctccgagggtcccatgacaacctagactgcccagggctcccccacccaggcccccaccctcttgctgctcgccctgctccctgcttcggtccagagaactggcagatactggtgggaagcactgtgcctggccccccagcttcctgtatgggcctcgaaacacaatgggccttctcgctcactggtagagacaggggttgtggtccccaacctgccttctgctctgcccctgcacaggacccaaaggccccaggccctgcaaggtgtgctagttcctgctttcccgcggacttcctagtgcccaaatgccctgtgaggctgagagacccaggcccctgtggctttcaacacagcacagctgtggaagtggctgtgttcttctacagcctgtggaagaacccctgtagcagagcctcccgtccaccctcaggggctgagncagctctcgaggagtggtgctcaagagctgacgcagggccacctccccttcccaagggggtgggagggagtgggcccacagggaaaagaaggcggctctgaaggaagatctcgcccacaccccaggacagaaagaggaaacaagcccgccctctggtgaaatgggactccctccatccaccaacacccaacctcctgaaagcttcacaacttcacgcagagtccggtgggcaggcaccaggcaggaaaggctcctcaagaggttcctggtggtctggcctaagccccagccagaggccctgctctctctggcctggggcatccacccgttgttctgaaggcagagcccattctgtgggctcacaagacacagtgaaggggatcatggcctgcacccctgcttttcagcagtaaaaagcccgaaaagcctggcgagcatggccgagctgggagggccgagccggaactccacgtccctcgagagcaggagcctcttaagggctggcactggtctcagcctaatggctgaggcggtaccctggcttcatatgcatctcactgctcccactgcaggggggcagggaaggggggtctgggagcccttcatgtgtgggggccgagctgggggcccccatggccatcctggacctcgctgctccagagtttaataaaggtagcacatgcttattgctagagcctttgcagaca

SEQ ID NO: 286104 - DNA, 3156 bp, Homo sapiens
ggcctgagttcggggccagcagccgtctacccggtgtcgcgttctgtgttgtggcggccctggatccggcgtcagggcgaccgggcggacgaggtggagccagagtctgtcaggcgggttggtgaagggcgcggggccgggcacggcgttgggagtgcgcggcagggaccggccaggcgggctgcaggcacctcagagcccgggacaccccctcaacgtccgcaggcgcgatgaaggcactgatcttagtggggggctatgggacgcggctacggccgctgacgctgagcaccccgaagccactggtggacttctgcaataagcccatcttgctgcaccaagtggaggcgctagccgcggcaggcgtggaccacgtgatcctggccgtgagctacatgtcgcaggtgctggagaaggaaatgaaggcacaggagcagaggctgggaatccgaatctccatgtcccatgaagaggagcctttggggacagctgggcccctggcgctggcccgtgacctactctctgagactgcagaccctttcttcgtcctcaacagtgacgtgatctgcgatttccccttccaagccatggtgcagttccaccggcaccatggccaggagggctccatcctggtgaccaaggtggaggaaccctccaagtacggtgtggtggtgtgtgaggctgacacaggccgcattcaccggttcgtggagaagccacaggtgtttgtgtccaataagatcaacgcaggcatgtacatcctgagccctgcagtgctgcggcgcatccagctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtacgcatggagaacgtgacagtgctgggtgaggacgtcatagttaatgatgagctctacctcaacggagccagcgtgctgccccacaagtctattggcgagtcagtgccagagcctcgtatcatcatgtgaggggatgcagtggggctggccgagccccggttttcccatcagcaaggggagtgctggcctgacacatcagaagaccctggacttgtcattatttgtctggggggcactgggtgaagctgaagctgttggacacctgccttctcatgtggacatcatctggcaggatccctgctgggcacaccccacaaaccccactccctcaagaagggccagggccagggctgtatggaataataatttaatgctcactgtggccctgactgaaagtcaagctcaggcacaattagggccatggctgggctcccaccaatgaggatacaggcaggcaaggaggttggatgtggtggtgtgggatacaggagaagggcaaagggagctcataaatagggcccagcctggctctgggttcaaaggtggaggttccaggatggcacaggctgtgagggctaggcagctgaggaggtagtactcgtattggctcccttctcccagtcctctacagacacgatggtggttttgcagaagaagcagtccttgttgttcatcaggtgctggttgatacaggctctacaacaggggaggggatgaggactgccctgcatgtacctactgctctccccaccaccaagctgtggggcccacttacttgcaggacttgtggccacagggctggaacacagcagagatggggtgggcatagcagatggggcagaggtcctcctcactggtgggctgcagggaggagagtgaagggtgggctggagttggatgcctggctatgtggatgtccgttgtgcctgtgtaggagtgcacacatattcaagtggcatggacctgtgcaccgtgttcccactcaccagggaggcagctgctgcctgggcagatgcagaggtcaggtgcgccagcatctgttccacttgggccagctcatcggcactgatataatccgcatctggggagtggtaggtagtgtcaagtcagaggtagctgaggatgtgatgcctcttgaatattcccagcctaggactttgctgttcttaaggctcctgacccgacccagccccagatttccctgacctgccccaccagcccactcacagctctgcagggagaagcgcttccggtcaggggctggcagagcagtgccaggtgctgggggctctggctgtcccaggagatagcatattgagcgtagctggaagcagggatctgccaggagcactgatgtggcttgctctctcctaggtaggggagggtgcaagggcagtcagaaggcttggggcctggctaaaagtctctcttgggattgccaatgaggagtgccatggctcgtacatgatcaccccccctgcatcctttccgtctccctgcttcccaaaccccaagtcctgtattctagtaaggtgccacacagcctgtttttttttttttttttcttgagacgagtctcgctctgttgcccaggctggagtgcgatggcacgatctcggctcactgcaacctccacctcccgggttcaagtgattctcctgctttagcctcccgagtagctggaattgcagacgcccaccaccacgcccggctaattgttgttgtatttttagtagagacagggtttcaccaggttggccaggctggtctcgaattcctgacctcaggtgatccacctgccttggcttcccaaagtgctgggattacaggcgtgagccaccgcgcccggcctggggtaccactttaagaaggctcaggcgaaccaccttaagatagtgagagtctgcctgccccataatattatcagtccttcaaagtcacttcaaataaacactaacagcagcttggagac

SEQ ID NO: 286105 - DNA, 6239 bp, Homo sapiens
  misc_feature (5532)..(5532): n is a, c, g, or t
ggcctgagttcggggccagcagccgtctacccggtgtcgcgttctgtgttgtggcggccctggatccggcgtcagggcgaccgggcggacgaggtggagccagagtctgtcaggcgggttggtgaagggcgcggggccgggcacggcgttgggagtgcgcggcagggaccggccaggcgggctgcaggcacctcagagcccgggacaccccctcaacgtccgcaggcgcgatgaaggcactgatcttagtggggggctatgggacgcggctacggccgctgacgctgagcaccccgaagccactggtggacttctgcaataagcccatcttgctgcaccaagtggaggcgctagccgcggcaggcgtggaccacgtgatcctggccgtgagctacatgtcgcaggtgctggagaaggaaatgaaggcacaggagcagaggctgggaatccgaatctccatgtcccatgaagaggagcctttggggacagctgggcccctggcgctggcccgtgacctactctctgagactgcagaccctttcttcgtcctcaacagtgacgtgatctgcgatttccccttccaagccatggtgcagttccaccggcaccatggccaggagggctccatcctggtgaccaaggtggaggaaccctccaagtacggtgtggtggtgtgtgaggctgacacaggccgcattcaccggttcgtggagaagccacaggtgtttgtgtccaataagatcaacgcaggcatgtacatcctgagccctgcagtgctgcggcgcatccagctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtacgcatggagaacgtgacagtgctgggtgaggacgtcatagttaatgatgagctctacctcaacggagccagcgtgctgccccacaagtctattggcgagtcagtgccagagcctcgtatcatcatgtgaggggatgcagtggggctggccgagccccggttttcccatcagcaaggggagtgctggcctgacacatcagaagaccctggacttgtcattatttgtctggggggcactgggtgaagctgaagctgttggacacctgccttctcatgtggacatcatctggcaggatccctgctgggcacaccccacaaaccccactccctcaagaagggccagggccagggctgtatggaataataatttaatgctcactgtggccctgactgaaagtcaagctcaggcacaattagggccatggctgggctcccaccaatgaggatacaggcaggcaaggaggttggatgtggtggtgtgggatacaggagaagggcaaagggagctcataaatagggcccagcctggctctgggttcaaaggtggaggttccaggatggcacaggctgtgagggctaggcagctgaggaggtagtactcgtattggctcccttctcccagtcctctacagacacgatggtggttttgcagaagaagcagtccttgttgttcatcaggtgctggttgatacaggctctacaacaggggaggggatgaggactgccctgcatgtacctactgctctccccaccaccaagctgtggggcccacttacttgcaggacttgtggccacagggctggaacacagcagagatggggtgggcatagcagatggggcagaggtcctcctcactggtgggctgcagggaggagagtgaagggtgggctggagttggatgcctggctatgtggatgtccgttgtgcctgtgtaggagtgcacacatattcaagtggcatggacctgtgcaccgtgttcccactcaccagggaggcagctgctgcctgggcagatgcagaggtcaggtgcgccagcatctgttccacttgggccagctcatcggcactgatataatccgcatctggggagtggtaggtagtgtcaagtcagaggtagctgaggatgtgatgcctcttgaatattcccagcctaggactttgctgttcttaaggctcctgacccgacccagccccagatttccctgacctgccccaccagcccactcacagctctgcagggagaagcgcttccggtcaggggctggcagagcagtgccaggtgctgggggctctggctgtcccaggagatagcatattgagcgtagctggaagcagggatctgccaggagcactgatgtggcttgctctctcctaggtaggggagggtgcaagggcagtcagaaggcttggggcctggctaaaagtctctcttgggattgccaatgaggagtgccatggctcgtacatgatcaccccccctgcatcctttccgtctccctgcttcccaaaccccaagtcctgtattctagtaaggtgccacacagcctgtttttttttttttttttcttgagacgagtctcgctctgttgcccaggctggagtgcgatggcacgatctcggctcactgcaacctccacctcccgggttcaagtgattctcctgctttagcctcccgagtagctggaattgcagacgcccaccaccacgcccggctaattgttgttgtatttttagtagagacagggtttcaccaggttggccaggctggtctcgaattcctgacctcaggtgatccacctgccttggcttcccaaagtgctgggattacaggcgtgagccaccgcgcccggcctggggtaccactttaagaaggctcaggcgaaccaccttaagatagtgagagtctgcctgccccataatattatcagtccttcaaagtcacttcaaataaacactaacagcagcttggagacattcttccagactcccccttttactccccgaggaaaaacgagcggcggagagctgccagccaaaggctgacggggactttggggttggccttgctccccatctggcggtcatgcggggccattgggcacaaagggatgtagccgccccgcctcctcaaacgggaaccaataggagcccgggccccgcccctggggggagtatttaggagccgatcaggaactcgcttggagagggctagcgaagccgaagggagcgcggctaagagtgccgcaccgcctcacaacctgggaaccggagagtaggggccgtcggctggcaagaacccgccgtgcctcctcggcaagggccatccggtgccacccatgtcgcactagagcagaagagggtgagtcctggaactgcaacctgcacagagctgctctgtactgtccctggtggtcgccgccatgacctggttggtgctgctggggacactgctctgcatgctgcgcgttgggttaggcaccccggactccgagggtttcccgccccgtgcgctccacaactgcccctacaaatgtatctgcgctgccgacctgctaagctgcactggcctagggctgcaggacgtgccagccgagttacctgccgctactgcggacctcgacctgagccacaacgcgctccagcgcctgcgccccggctggttggcgcccctcttccagctgcgcgccctgcacctagaccacaacgaactagatgcgctgggtcgcggcgtcttcgtcaacgccagcggcctgaggctgctcgatctatcatctaacacgttgcgggcgcttggccgccacgacctcgacgggctgggggcgctggagaagctgcttctgttcaataaccgcttggtgcacttggacgagcatgccttccacggcctgcgcgcgctcagccatctctacctgggctgcaacgaactcgcctcgttctccttcgaccacctgcacggtctgagcgccacccacctgcttactctggacctctcctccaaccggctgggacacatctccgtacctgagctggccgcgctgccggccttcctcaagaacggcctctacttgcacaacaaccctttgccttgcgactgccgcctctaccacctgctacagcgctggcaccagcggggcctgagcgccgtgcgcgactttgcgcgcgagtacgtatgcttggccttcaaggtacccgcgtcccgcgtgcgcttcttccagcacagccgcgtctttgagaactgctcgtcggccccagctcttggcctagagcggccggaagagcacctgtacgcgctggtgggtcggtccctgaggctttactgcaacaccagcgtcccggccatgcgcattgcctgggtttcgccgcagcaggagcttctcagggcgccaggatcccgcgatggcagcatcgcggtgctggccgacggcagcttggccataggcaacgtacaggagcagcatgcgggactcttcgtgtgcctggccactgggccccgcctgcaccacaaccagacgcacgagtacaacgtgagcgtgcactttccgcgcccagagcccgaggctttcaacacaggcttcaccacactgctgggctgtgccgtgggccttgtgctcgtgctgctctacctgttcgccccaccctgccgctgctgccgccgtgcctgccgctgccgccgctggccccaaacacccagcccgctccaagagctgagcgcacagtcctcagtactcagcaccacaccgccagacgcacccagccgcaaggccagcgtccacaagcacgtagtctttctggagccaggccggaggggcctcaatggccgcgtgcagctggcagtagctgaggaattcgatctctacaaccctggaggcctgcagctgaaggctggctctgagtccgccagctccataggctccgagggtcccatgacaacctagactgcccagggctcccccacccaggcccccaccctcttgctgctcgccctgctccctgcttcggtccagagaactggcagatactggtgggaagcactgtgcctggccccccagcttcctgtatgggcctcgaaacacaatgggccttctcgctcactggtagagacaggggttgtggtccccaacctgccttctgctctgcccctgcacaggacccaaaggccccaggccctgcaaggtgtgctagttcctgctttcccgcggacttcctagtgcccaaatgccctgtgaggctgagagacccaggcccctgtggctttcaacacagcacagctgtggaagtggctgtgttcttctacagcctgtggaagaacccctgtagcagagcctcccgtccaccctcaggggctgagncagctctcgaggagtggtgctcaagagctgacgcagggccacctccccttcccaagggggtgggagggagtgggcccacagggaaaagaaggcggctctgaaggaagatctcgcccacaccccaggacagaaagaggaaacaagcccgccctctggtgaaatgggactccctccatccaccaacacccaacctcctgaaagcttcacaacttcacgcagagtccggtgggcaggcaccaggcaggaaaggctcctcaagaggttcctggtggtctggcctaagccccagccagaggccctgctctctctggcctggggcatccacccgttgttctgaaggcagagcccattctgtgggctcacaagacacagtgaaggggatcatggcctgcacccctgcttttcagcagtaaaaagcccgaaaagcctggcgagcatggccgagctgggagggccgagccggaactccacgtccctcgagagcaggagcctcttaagggctggcactggtctcagcctaatggctgaggcggtaccctggcttcatatgcatctcactgctcccactgcaggggggcagggaaggggggtctgggagcccttcatgtgtgggggccgagctgggggcccccatggccatcctggacctcgctgctccagagtttaataaaggtagcacatgcttattgctagagcctttgcagaca

SEQ ID NO: 286106 - DNA, 2177 bp, Homo sapiens
ggcctgagttcggggccagcagccgtctacccggtgtcgcgttctgtgttgtggcggccctggatccggcgtcagggcgaccgggcggacgaggtggagccagagtctgtcaggcgggttggtgaagggcgcggggccgggcacggcgttgggagtgcgcggcagggaccggccaggcgggctgcaggcacctcagagcccgggacaccccctcaacgtccgcaggcgcgatgaaggcactgatcttagtggggggctatgggacgcggctacggccgctgacgctgagcaccccgaagccactggtggacttctgcaataagcccatcttgctgcaccaagtggaggcgctagccgcggcaggcgtggaccacgtgatcctggccgtgagctacatgtcgcaggtgctggagaaggaaatgaaggcacaggagcagaggctgggaatccgaatctccatgtcccatgaagaggagcctttggggacagctgggcccctggcgctggcccgtgacctactctctgagactgcagaccctttcttcgtcctcaacagtgacgtgatctgcgatttccccttccaagccatggtgcagttccaccggcaccatggccaggagggctccatcctggtgaccaaggtggaggaaccctccaagtacggtgtggtggtgtgtgaggctgacacaggccgcattcaccggttcgtggagaagccacaggtgtttgtgtccaataagatcaacgcaggcatgtacatcctgagccctgcagtgctgcggcgcatccagctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtacgcatggagaacgtgacagtgctgggtgaggacgtcatagttaatgatgagctctacctcaacggagccagcgtgctgccccacaagtctattggcgagtcagtgccagagcctcgtatcatcatgtgaggggatgcagtggggctggccgagccccggttttcccatcagcaaggggagtgctggcctgacacatcagaagaccctggacttgtcattatttgtctggggggcactgggtgaagctgaagctgttggacacctgccttctcatgtggacatcatctggcaggatccctgctgggcacaccccacaaaccccactccctcaagaagggccagggccagggctgtatggaataataatttaatgctcactgtgaaaaaaaaaaaaaaaaaaaaaaaaaaaaaaaaaaaaaaaaaaaaaaaaaaacaaaaaaaaaaaaaaaaaagacacgaaaaaaaaaccagggaacgccacagacaaaacagggcccagcgtcggcggcaggacgcaagcagcgagcgcggagaggaaagcctgcaccgggagcagcggatgatcaatacccaacacccccccggcacgggaaacgcggcagcccgaccacgtccggcacggcgagagggccagccgcaccggtagcgccactgagactcaggacacccccgccgacaggccggcgagaacccgatgtgacgaggcaccacgcggaggaggatcgagaacgcctgacagccctgccgctgggaactgagcgagcacacgcagggaagcggagagcgaacggaccaacgtcaagcgacaccgacagcaccagcgcgaggacacgacgaagcgactgaagagcgaaagaaacgccggccggcagcagcgcgcgcgaagccagacacggacgcagccgcgcccgcacgccacggcaagcgaagaggacacgcaagcagagagaccgccggccgacaacgaggcagagtgagacaagcacggaaagg

SEQ ID NO: 286107 - DNA, 2765 bp, Homo sapiens
ggcctgagttcggggccagcagccgtctacccggtgtcgcgttctgtgttgtggcggccctggatccggcgtcagggcgaccgggcggacgaggtggagccagagtctgtcaggcgggttggtgaagggcgcggggccgggcacggcgttgggagtgcgcggcagggaccggccaggcgggctgcaggcacctcagagcccgggacaccccctcaacgtccgcaggcgcgatgaaggcactgatcttagtggggggctatgggacgcggctacggccgctgacgctgagcaccccgaagccactggtggacttctgcaataagcccatcttgctgcaccaagtggaggcgctagccgcggcaggcgtggaccacgtgatcctggccgtgagctacatgtcgcaggtgctggagaaggaaatgaaggcacaggagcagaggctgggaatccgaatctccatgtcccatgaagaggagcctttggggacagctgggcccctggcgctggcccgtgacctactctctgagactgcagaccctttcttcgtcctcaacagtgacgtgatctgcgatttccccttccaagccatggtgcagttccaccggcaccatggccaggagggctccatcctggtgaccaaggtggaggaaccctccaagtacggtgtggtggtgtgtgaggctgacacaggccgcattcaccggttcgtggagaagccacaggtgtttgtgtccaataagatcaacgcaggcatgtacatcctgagccctgcagtgctgcggcgcatccagctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtacgcatggagaacgtgacagtgctgggtgaggacgtcatagttaatgatgagctctacctcaacggagccagcgtgctgccccacaagtctattggcgagtcagtgccagagcctcgtatcatcatgtgaggggatgcagtggggctggccgagccccggttttcccatcagcaaggggagtgctggcctgacacatcagaagaccctggacttgtcattatttgtctggggggcactgggtgaagctgaagctgttggacacctgccttctcatgtggacatcatctggcaggatccctgctgggcacaccccacaaaccccactccctcaagaagggccagggccagggctgtatggaataataatttaatgctcactgtggccctgactgaaagtcaagctcaggcacaattagggccatggctgggctcccaccaatgaggatacaggcaggcaaggaggttggatgtggtggtgtgggatacaggagaagggcaaagggagctcataaatagggcccagcctggctctgggttcaaaggtggaggttccaggatggcacaggctgtgagggctaggcagctgaggaggtagtactcgtattggctcccttctcccagtcctctacagacacgatggtggttttgcagaagaagcagtccttgttgttcatcaggtgctggttgatacaggctctacaacaggggaggggatgaggactgccctgcatgtacctactgctctccccaccaccaagctgtggggcccacttacttgcaggacttgtggccacagggctggaacacagcagagatggggtgggcatagcagatggggcagaggtcctcctcactggtgggctgcagggaggagagtgaagggtgggctggagttggatgcctggctatgtggatgtccgttgtgcctgtgtaggagtgcacacatattcaagtggcatggacctgtgcaccgtgttcccactcaccagggaggcagctgctgcctgggcagatgcagaggtcaggtgcgccagcatctgttccacttgggccagctcatcggcactgatataatccgcatctggggagtggtaggtagtgtcaagtcagaggtagctgaggatgtgatgcctcttgaatattcccagcctaggactttgctgttcttaaggctcctgacccgacccagccccagatttccctgacctgccccaccagcccactcacagctctgcagggagaagcgcttccggtcaggggctggcagagcagtgccaggtgctgggggctctggctgtcccaggagatagcatattgagcgtagctggaagcagggatctgccaggagcactgatgtggcttgctctctcctaggtaggggagggtgcaagggcagtcagaaggcttggggcctggctaaaagtctctcttgggattgccaatgaggagtgccatggctcgtacatgatcaccccccctgcatcctttccgtctccctgcttcccaaaccccaagtcctgtattctagtaaggtgccacacagcgctgggcaacaagagcaaaactccatctcaaaaaaaa

SEQ ID NO: 286108 - DNA, 3028 bp, Homo sapiens
ggcctgagttcggggccagcagccgtctacccggtgtcgcgttctgtgttgtggcggccctggatccggcgtcaggacaccccctcaacgtccgcaggcgcgatgaaggcactgatcttagtggggggctatgggacgcggctacggccgctgacgctgagcaccccgaagccactggtggacttctgcaataagcccatcttgctgcaccaagtggaggcgctagccgcggcaggcgtggaccacgtgatcctggccgtgagctacatgtcgcaggtgctggagaaggaaatgaaggcacaggagcagaggctgggaatccgaatctccatgtcccatgaagaggagcctttggggacagctgggcccctggcgctggcccgtgacctactctctgagactgcagaccctttcttcgtcctcaacagtgacgtgatctgcgatttccccttccaagccatggtgcagttccaccggcaccatggccaggagggctccatcctggtgaccaaggtggaggaaccctccaagtacggtgtggtggtgtgtgaggctgacacaggccgcattcaccggttcgtggagaagccacaggtgtttgtgtccaataagatcaacgcaggcatgtacatcctgagccctgcagtgctgcggcgcatccagctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtacgcatggagaacgtgacagtgctgggtgaggacgtcatagttaatgatgagctctacctcaacggagccagcgtgctgccccacaagtctattggcgagtcagtgccagagcctcgtatcatcatgtgaggggatgcagtggggctggccgagccccggttttcccatcagcaaggggagtgctggcctgacacatcagaagaccctggacttgtcattatttgtctggggggcactgggtgaagctgaagctgttggacacctgccttctcatgtggacatcatctggcaggatccctgctgggcacaccccacaaaccccactccctcaagaagggccagggccagggctgtatggaataataatttaatgctcactgtggccctgactgaaagtcaagctcaggcacaattagggccatggctgggctcccaccaatgaggatacaggcaggcaaggaggttggatgtggtggtgtgggatacaggagaagggcaaagggagctcataaatagggcccagcctggctctgggttcaaaggtggaggttccaggatggcacaggctgtgagggctaggcagctgaggaggtagtactcgtattggctcccttctcccagtcctctacagacacgatggtggttttgcagaagaagcagtccttgttgttcatcaggtgctggttgatacaggctctacaacaggggaggggatgaggactgccctgcatgtacctactgctctccccaccaccaagctgtggggcccacttacttgcaggacttgtggccacagggctggaacacagcagagatggggtgggcatagcagatggggcagaggtcctcctcactggtgggctgcagggaggagagtgaagggtgggctggagttggatgcctggctatgtggatgtccgttgtgcctgtgtaggagtgcacacatattcaagtggcatggacctgtgcaccgtgttcccactcaccagggaggcagctgctgcctgggcagatgcagaggtcaggtgcgccagcatctgttccacttgggccagctcatcggcactgatataatccgcatctggggagtggtaggtagtgtcaagtcagaggtagctgaggatgtgatgcctcttgaatattcccagcctaggactttgctgttcttaaggctcctgacccgacccagccccagatttccctgacctgccccaccagcccactcacagctctgcagggagaagcgcttccggtcaggggctggcagagcagtgccaggtgctgggggctctggctgtcccaggagatagcatattgagcgtagctggaagcagggatctgccaggagcactgatgtggcttgctctctcctaggtaggggagggtgcaagggcagtcagaaggcttggggcctggctaaaagtctctcttgggattgccaatgaggagtgccatggctcgtacatgatcaccccccctgcatcctttccgtctccctgcttcccaaaccccaagtcctgtattctagtaaggtgccacacagcctgtttttttttttttttttcttgagacgagtctcgctctgttgcccaggctggagtgcgatggcacgatctcggctcactgcaacctccacctcccgggttcaagtgattctcctgctttagcctcccgagtagctggaattgcagacgcccaccaccacgcccggctaattgttgttgtatttttagtagagacagggtttcaccaggttggccaggctggtctcgaattcctgacctcaggtgatccacctgccttggcttcccaaagtgctgggattacaggcgtgagccaccgcgcccggcctggggtaccactttaagaaggctcaggcgaaccaccttaagatagtgagagtctgcctgccccataatattatcagtccttcaaagtcacttcaaataaacactaacagcagcttggagac

SEQ ID NO: 286109 - DNA, 3462 bp, Homo sapiens
ggcctgagttcggggccagcagccgtctacccggtgtcgcgttctgtgttgtggcggccctggatccggcgtcagggcgaccgggcggacgaggtggagccagagtctgtcaggcgggttggtgaagggcgcggggccgggcacggcgttgggagtgcgcggcagggaccggccaggcgggctgcaggcacctcagagcccgggacaccccctcaacgtccgcaggcgcgatgaaggcactgatcttagtggggggctatgggacgcggctacggccgctgacgctgagcaccccgaagccactggtggacttctgcaataagcccatcttgctgcaccaagtggaggcgctagccgcggcaggcgtggaccacgtgatcctggccgtgagctacatgtcgcaggtgctggagaaggaaatgaaggcacaggagcagagggtgaggcacagactcttggcccttattctcggtccccgcccaacttcccatcctggtagaacctgactgggggggcctcttccttccagctgggaatccgaatctccatgtcccatgaagaggagcctttggggacagctgggcccctggcgctggcccgtgacctactctctgagactgcagaccctttcttcgtcctcaacagtgacgtgatctgcgatttccccttccaagccatggtgcagttccaccggcaccatggccaggagggctccatcctggtaaggcgccaggtcttctctctcttgacactttcaccctccatgcccagcctcccatgccccctagccttcatctgccttcggatgttatggatacagagctgtgcagtatgtatctttaagcacttggggcagagtctcttgagatctggaacggcatgtgtatcaaggcttaggaacactggactaggtccgaggtccccttccttgcattcaggtgaccaaggtggaggaaccctccaagtacggtgtggtggtgtgtgaggctgacacaggccgcattcaccggttcgtggagaagccacaggtgtttgtgtccaataagatcaacgcaggcatgtacatcctgagccctgcagtgctgcggcgcatccagctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtacgcatggagaacgtgacagtgctgggtgaggacgtcatagttaatgatgagctctacctcaacggagccagcgtgctgccccacaagtctattggcgagtcagtgccagagcctcgtatcatcatgtgaggggatgcagtggggctggccgagccccggttttcccatcagcaaggggagtgctggcctgacacatcagaagaccctggacttgtcattatttgtctggggggcactgggtgaagctgaagctgttggacacctgccttctcatgtggacatcatctggcaggatccctgctgggcacaccccacaaaccccactccctcaagaagggccagggccagggctgtatggaataataatttaatgctcactgtggccctgactgaaagtcaagctcaggcacaattagggccatggctgggctcccaccaatgaggatacaggcaggcaaggaggttggatgtggtggtgtgggatacaggagaagggcaaagggagctcataaatagggcccagcctggctctgggttcaaaggtggaggttccaggatggcacaggctgtgagggctaggcagctgaggaggtagtactcgtattggctcccttctcccagtcctctacagacacgatggtggttttgcagaagaagcagtccttgttgttcatcaggtgctggttgatacaggctctacaacaggggaggggatgaggactgccctgcatgtacctactgctctccccaccaccaagctgtggggcccacttacttgcaggacttgtggccacagggctggaacacagcagagatggggtgggcatagcagatggggcagaggtcctcctcactggtgggctgcagggaggagagtgaagggtgggctggagttggatgcctggctatgtggatgtccgttgtgcctgtgtaggagtgcacacatattcaagtggcatggacctgtgcaccgtgttcccactcaccagggaggcagctgctgcctgggcagatgcagaggtcaggtgcgccagcatctgttccacttgggccagctcatcggcactgatataatccgcatctggggagtggtaggtagtgtcaagtcagaggtagctgaggatgtgatgcctcttgaatattcccagcctaggactttgctgttcttaaggctcctgacccgacccagccccagatttccctgacctgccccaccagcccactcacagctctgcagggagaagcgcttccggtcaggggctggcagagcagtgccaggtgctgggggctctggctgtcccaggagatagcatattgagcgtagctggaagcagggatctgccaggagcactgatgtggcttgctctctcctaggtaggggagggtgcaagggcagtcagaaggcttggggcctggctaaaagtctctcttgggattgccaatgaggagtgccatggctcgtacatgatcaccccccctgcatcctttccgtctccctgcttcccaaaccccaagtcctgtattctagtaaggtgccacacagcctgtttttttttttttttttcttgagacgagtctcgctctgttgcccaggctggagtgcgatggcacgatctcggctcactgcaacctccacctcccgggttcaagtgattctcctgctttagcctcccgagtagctggaattgcagacgcccaccaccacgcccggctaattgttgttgtatttttagtagagacagggtttcaccaggttggccaggctggtctcgaattcctgacctcaggtgatccacctgccttggcttcccaaagtgctgggattacaggcgtgagccaccgcgcccggcctggggtaccactttaagaaggctcaggcgaaccaccttaagatagtgagagtctgcctgccccataatattatcagtccttcaaagtcacttcaaataaacactaacagcagcttggagac

SEQ ID NO: 286110 - DNA, 2965 bp, Homo sapiens
ggcctgagttcggggccagcagccgtctacccggtgtcgcgttctgtgttgtggcggccctggatccggcgtcagggcgaccgggcggacgaggtggagccagagtctgtcaggcgggttggtgaagggcgcggggccgggcacggcgttgggagtgcgcggcagggaccggccaggcgggctgcaggcacctcagagcccgggacaccccctcaacgtccgcaggcgcgatgaaggcactgatcttagtggggggctatgggacgcggctacggccgctgacgctgagcaccccgaagccactggtggacttctgcaataagcccatcttgctgcaccaagtggaggcgctagccgcggcaggcgtggaccacgtgatcctggccgtgagctacatgtcgcaggtgctggagaaggaaatgaaggcacaggagcagaggctgggaatccgaatctccatgtcccatgaagaggagcctttggggacagctgggcccctggcgctggcccgtgacctactctctgagactgcagaccctttcttcgtcctcaacagcaggcatgtacatcctgagccctgcagtgctgcggcgcatccagctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtacgcatggagaacgtgacagtgctgggtgaggacgtcatagttaatgatgagctctacctcaacggagccagcgtgctgccccacaagtctattggcgagtcagtgccagagcctcgtatcatcatgtgaggggatgcagtggggctggccgagccccggttttcccatcagcaaggggagtgctggcctgacacatcagaagaccctggacttgtcattatttgtctggggggcactgggtgaagctgaagctgttggacacctgccttctcatgtggacatcatctggcaggatccctgctgggcacaccccacaaaccccactccctcaagaagggccagggccagggctgtatggaataataatttaatgctcactgtggccctgactgaaagtcaagctcaggcacaattagggccatggctgggctcccaccaatgaggatacaggcaggcaaggaggttggatgtggtggtgtgggatacaggagaagggcaaagggagctcataaatagggcccagcctggctctgggttcaaaggtggaggttccaggatggcacaggctgtgagggctaggcagctgaggaggtagtactcgtattggctcccttctcccagtcctctacagacacgatggtggttttgcagaagaagcagtccttgttgttcatcaggtgctggttgatacaggctctacaacaggggaggggatgaggactgccctgcatgtacctactgctctccccaccaccaagctgtggggcccacttacttgcaggacttgtggccacagggctggaacacagcagagatggggtgggcatagcagatggggcagaggtcctcctcactggtgggctgcagggaggagagtgaagggtgggctggagttggatgcctggctatgtggatgtccgttgtgcctgtgtaggagtgcacacatattcaagtggcatggacctgtgcaccgtgttcccactcaccagggaggcagctgctgcctgggcagatgcagaggtcaggtgcgccagcatctgttccacttgggccagctcatcggcactgatataatccgcatctggggagtggtaggtagtgtcaagtcagaggtagctgaggatgtgatgcctcttgaatattcccagcctaggactttgctgttcttaaggctcctgacccgacccagccccagatttccctgacctgccccaccagcccactcacagctctgcagggagaagcgcttccggtcaggggctggcagagcagtgccaggtgctgggggctctggctgtcccaggagatagcatattgagcgtagctggaagcagggatctgccaggagcactgatgtggcttgctctctcctaggtaggggagggtgcaagggcagtcagaaggcttggggcctggctaaaagtctctcttgggattgccaatgaggagtgccatggctcgtacatgatcaccccccctgcatcctttccgtctccctgcttcccaaaccccaagtcctgtattctagtaaggtgccacacagcctgtttttttttttttttttcttgagacgagtctcgctctgttgcccaggctggagtgcgatggcacgatctcggctcactgcaacctccacctcccgggttcaagtgattctcctgctttagcctcccgagtagctggaattgcagacgcccaccaccacgcccggctaattgttgttgtatttttagtagagacagggtttcaccaggttggccaggctggtctcgaattcctgacctcaggtgatccacctgccttggcttcccaaagtgctgggattacaggcgtgagccaccgcgcccggcctggggtaccactttaagaaggctcaggcgaaccaccttaagatagtgagagtctgcctgccccataatattatcagtccttcaaagtcacttcaaataaacactaacagcagcttggagac

SEQ ID NO: 286111 - DNA, 2441 bp, Homo sapiens
gactcctagaggattcccaggcaaagctcctacaacgcaggcattaccatctgagccctgcagtgctgcggcgcatctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtacgcatggagaacgtgacagtgctgggtgaggacgtcatagttaatgatgagctctacctcaacggagccagcgtgctgccccacaagtctattggcgagtcagtgccagagcctcgtatcatcatgtgaggggatgcagtggggctggccgagccccggttttcccatcagcaaggggagtgctggcctgacacatcagaagaccctggacttgtcattatttgtctggggggcactgggtgaagctgaagctgttggacacctgccttctcatgtggacatcatctggcaggatccctgctgggcacaccccacaaaccccactccctcaagaagggccagggccagggctgtatggaataataatttaatgctcactgtggccctgactgaaagtcaagctcaggcacaattagggccatggctgggctcccaccaatgaggatacaggcaggcaaggaggttggatgtggtggtgtgggatacaggagaagggcaaagggagctcataaatagggcccagcctggctctgggttcaaaggtggaggttccaggatggcacaggctgtgagggctaggcagctgaggaggtagtactcgtattggctcccttctcccagtcctctacagacacgatggtggttttgcagaagaagcagtccttgttgttcatcaggtgctggttgatacaggctctacaacaggggaggggatgaggactgccctgcatgtacctactgctctccccaccaccaagctgtggggcccacttacttgcaggacttgtggccacagggctggaacacagcagagatggggtgggcatagcagatggggcagaggtcctcctcactggtgggctgcagggaggagagtgaagggtgggctggagttggatgcctggctatgtggatgtccgttgtgcctgtgtaggagtgcacacatattcaagtggcatggacctgtgcaccgtgttcccactcaccagggaggcagctgctgcctgggcagatgcagaggtcaggtgcgccagcatctgttccacttgggccagctcatcggcactgatataatccgcatctggggagtggtaggtagtgtcaagtcagaggtagctgaggatgtgatgcctcttgaatattcccagcctaggactttgctgttcttaaggctcctgacccgacccagccccagatttccctgacctgccccaccagcccactcacagctctgcagggagaagcgcttccggtcaggggctggcagagcagtgccaggtgctgggggctctggctgtcccaggagatagcatattgagcgtagctggaagcagggatctgccaggagcactgatgtggcttgctctctcctaggtaggggagggtgcaagggcagtcagaaggcttggggcctggctaaaagtctctcttgggattgccaatgaggagtgccatggctcgtacatgatcaccccccctgcatcctttccgtctccctgcttcccaaaccccaagtcctgtattctagtaaggtgccacacagcctgtttttttttttttttttcttgagacgagtctcgctctgttgcccaggctggagtgcgatggcacgatctcggctcactgcaacctccacctcccgggttcaagtgattctcctgctttagcctcccgagtagctggaattgcagacgcccaccaccacgcccggctaattgttgttgtatttttagtagagacagggtttcaccaggttggccaggctggtctcgaattcctgacctcaggtgatccacctgccttggcttcccaaagtgctgggattacaggcgtgagccaccgcgcccggcctggggtaccactttaagaaggctcaggcgaaccaccttaagatagtgagagtctgcctgccccataatattatcagtccttcaaagtcacttcaaataaacactaacagcagcttggagac

SEQ ID NO: 286112 - DNA, 2172 bp, Homo sapiens
gaaaaaatttgtgtggccacaagaggtgacaaagccccaaatatacaaaagggccccaaattaaactgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtacgcatggagaacgtgacagtgctgggtgaggacgtcatagttaatgatgagctctacctcaacggagccagcgtgctgccccacaagtctattggcgagtcagtgccagagcctcgtatcatcatgtgaggggatgcagtggggctggccgagccccggttttcccatcagcaaggggagtgctggcctgacacatcagaagaccctggacttgtcattatttgtctggggggcactgggtgaagctgaagctgttggacacctgccttctcatgtggacatcatctggcaggatccctgctgggcacaccccacaaaccccactccctcaagaagggccagggccagggctgtatggaataataatttaatgctcactgtggccctgactgaaagtcaagctcaggcacaattagggccatggctgggctcccaccaatgaggatacaggcaggcaaggaggttggatgtggtggtgtgggatacaggagaagggcaaagggagctcataaatagggcccagcctggctctgggttcaaaggtggaggttccaggatggcacaggctgtgagggctaggcagctgaggaggtagtactcgtattggctcccttctcccagtcctctacagacacgatggtggttttgcagaagaagcagtccttgttgttcatcaggtgctggttgatacaggctctacaacaggggaggggatgaggactgccctgcatgtacctactgctctccccaccaccaagctgtggggcccacttacttgcaggacttgtggccacagggctggaacacagcagagatggggtgggcatagcagatggggcagaggtcctcctcactggtgggctgcagggaggagagtgaagggtgggctggagttggatgcctggctatgtggatgtccgttgtgcctgtgtaggagtgcacacatattcaagtggcatggacctgtgcaccgtgttcccactcaccagggaggcagctgctgcctgggcagatgcagaggtcaggtgcgccagcatctgttccacttgggccagctcatcggcactgatataatccgcatctggggagtggtaggtagtgtcaagtcagaggtagctgaggatgtgatgcctcttgaatattcccagcctaggactttgctgttcttaaggctcctgacccgacccagccccagatttccctgacctgccccaccagcccactcacagctctgcagggagaagcgcttccggtcaggggctggcagagcagtgccaggtgctgggggctctggctgtcccaggagatagcatattgagcgtagctggaagcagggatctgccaggagcactgatgtggcttgctctctcctaggtaggggagggtgcaagggcagtcagaaggcttggggcctggctaaaagtctctcttgggattgccaatgaggagtgccatggctcgtacatgatcaccccccctgcatcctttccgtctccctgcttcccaaaccccaagtcctgtattctagtaaggtgccacacagcctgtttttttttttttttttcttgagacgagtctcgctctgttgcccaggctggagtgcgatggcacgatctcggctcactgcaacctccacctcccgggttcaagtgattctcctgctttagcctcccgagtagctggaattgcagacgcccaccaccacgcccggctaattgttgttgtatttttagtagagacagggtttcaccaggttggccaggctggtctcgaattcctgacctcaggtgatccacctgccttggcttcccaaagtgctgggattacaggcgtgagccaccgcgcccggcctggggtaccactttaagaaggctcaggcgaaccaccttaagatagtgagagtctgcctgccccataatattatcagtccttcaaagtcacttcaaataaacactaacagcagcttggagac

SEQ ID NO: 286113 - DNA, 1115 bp, Homo sapiens
ggcctgagttcggggccagcagccgtctacccggtgtcgcgttctgtgttgtggcggccctggatccggcgtcagggcgaccgggcggacgaggtggagccagagtctgtcaggcgggttggtgaagggcgcggggccgggcacggcgttgggagtgcgcggcagggaccggccaggcgggctgcaggcacctcagagcccgggacaccccctcaacgtccgcaggcgcgatgaaggcactgatcttagtggggggctatgggacgcggctacggccgctgacgctgagcaccccgaagccactggtggacttctgcaataagcccatcttgctgcaccaagtggaggcgctagccgcggcaggcgtggaccacgtgatcctggccgtgagctacatgtcgcaggtgctggagaaggaaatgaaggcacaggagcagaggctgggaatccgaatctccatgtcccatgaagaggagcctttggggacagctgggcccctggcgctggcccgtgacctactctctgagactgcagaccctttcttcgtcctcaacagtgacgtgatctgcgatttccccttccaagccatggtgcagttccaccggcaccatggccaggagggctccatcctggtgaccaaggtggaggaaccctccaagtacggtgtggtggtgtgtgaggctgacacaggccgcattcaccggttcgtggagaagccacaggtgtttgtgtccaataagatcaacgcaggcatgtacatcctgagccctgcagtgctgcggcgcatccagctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcaggaatgggaacggatccgggcatcccgcagcaccgtgcaccgccggatacacacaccatcttcga

SEQ ID NO: 286114 - DNA, 2087 bp, Homo sapiens
gccataatggggaagactccttctcaatggacgtaggctgcagctggatgcgccgcagcactgcaggtctcaggatgtacatgcctgcgttgatcttattggacacaaacacctgtggcttctccacgaaccggtgctgggtgaggacgtcatagttaatgatgagctctacctcaacggagccagcgtgctgccccacaagtctattggcgagtcagtgccagagcctcgtatcatcatgtgaggggatgcagtggggctggccgagccccggttttcccatcagcaaggggagtgctggcctgacacatcagaagaccctggacttgtcattatttgtctggggggcactgggtgaagctgaagctgttggacacctgccttctcatgtggacatcatctggcaggatccctgctgggcacaccccacaaaccccactccctcaagaagggccagggccagggctgtatggaataataatttaatgctcactgtggccctgactgaaagtcaagctcaggcacaattagggccatggctgggctcccaccaatgaggatacaggcaggcaaggaggttggatgtggtggtgtgggatacaggagaagggcaaagggagctcataaatagggcccagcctggctctgggttcaaaggtggaggttccaggatggcacaggctgtgagggctaggcagctgaggaggtagtactcgtattggctcccttctcccagtcctctacagacacgatggtggttttgcagaagaagcagtccttgttgttcatcaggtgctggttgatacaggctctacaacaggggaggggatgaggactgccctgcatgtacctactgctctccccaccaccaagctgtggggcccacttacttgcaggacttgtggccacagggctggaacacagcagagatggggtgggcatagcagatggggcagaggtcctcctcactggtgggctgcagggaggagagtgaagggtgggctggagttggatgcctggctatgtggatgtccgttgtgcctgtgtaggagtgcacacatattcaagtggcatggacctgtgcaccgtgttcccactcaccagggaggcagctgctgcctgggcagatgcagaggtcaggtgcgccagcatctgttccacttgggccagctcatcggcactgatataatccgcatctggggagtggtaggtagtgtcaagtcagaggtagctgaggatgtgatgcctcttgaatattcccagcctaggactttgctgttcttaaggctcctgacccgacccagccccagatttccctgacctgccccaccagcccactcacagctctgcagggagaagcgcttccggtcaggggctggcagagcagtgccaggtgctgggggctctggctgtcccaggagatagcatattgagcgtagctggaagcagggatctgccaggagcactgatgtggcttgctctctcctaggtaggggagggtgcaagggcagtcagaaggcttggggcctggctaaaagtctctcttgggattgccaatgaggagtgccatggctcgtacatgatcaccccccctgcatcctttccgtctccctgcttcccaaaccccaagtcctgtattctagtaaggtgccacacagcctgtttttttttttttttttcttgagacgagtctcgctctgttgcccaggctggagtgcgatggcacgatctcggctcactgcaacctccacctcccgggttcaagtgattctcctgctttagcctcccgagtagctggaattgcagacgcccaccaccacgcccggctaattgttgttgtatttttagtagagacagggtttcaccaggttggccaggctggtctcgaattcctgacctcaggtgatccacctgccttggcttcccaaagtgctgggattacaggcgtgagccaccgcgcccggcctggggtaccactttaagaaggctcaggcgaaccaccttaagatagtgagagtctgcctgccccataatattatcagtccttcaaagtcacttcaaataaacactaacagcagcttggagac

SEQ ID NO: 286115 - DNA, 180 bp, Homo sapiens
  misc_feature (21)..(21): n is a, c, g, or t
ctggttgactctcgaggatcnccggaatacacagcggaagcttggggaacagtccatacctggggtgacagggaaggaagatggagcagtaggggaactgaccgtggagagaactggtgtaacacagcatcacaaggctggggagaccagagtttcacgacagagaagacagtcaaaaag

SEQ ID NO: 286116 - DNA, 824 bp, Homo sapiens
gccttttacagaagtggctccagggagcatccacatctgcctctcggggcccacggggcccaggccagctacagaagcaccctgctttccatgggaaaatgctgcaaatgggggagaaaggagagaagggtttcagactgcaaagacccttcgacatcagctagcaccaagttccatcatgtaaataaactgaagggcttcagaccgggagtgaagccaagcaggtgatagaagtgtttgtaggaggatttttttgacataaacatgaaatggagcgagtggtaacgccatccgtctcctgcccagacctccccactgtcactgtccagcctgaagccgccctggtgaagcaggtggaggagcagctccaggcccggctccccggcctccctccctcagctccagggcactcacgtgcttgaaacagctgacgggagcagccttgtaactgtgatccttcaggaacttcccccagtcgaagcccaagaccagagctgcagagcagagaggacgagtcagactaggagcctgcgcagcagccactccaggagcctggaccccaagggccctgtgggacctgcagaggtgatcccaacatgcaggcaaatttgggaagcagtgttgcagatgctggtcccagctactgggaaacaaggtaagatgaggcccctgagatgaggttccagcctcaattccgccattctcctcctacagagccacactaggtatgtcattctacctccttggacctcagtatacttatcaataaatgtgtgggttcaacaccacatccaagaatctttccatctctaaagattctataa

SEQ ID NO: 286117 - DNA, 584 bp, Homo sapiens
agagaggccgggagctcgggcggccggacggaggagggacgaggcagcgcgcgggggagcgcgccctcgccctggcccctccgagtcttcgactagtccttgcaacttcttggcgtgataatcgggaaaagttggcccgtgccaggtttccgacagggatcaaacaggaaaatgcatggcacattattaatgagacttgagaagggggcatctctctgtgatctgtctgtctacggacctcattcattctcctctctcttccacaaagagaactcacaaaggcctgtgaccagagggtgcttaaaatttcagagacgaatgtgaatattactttcaaatctccaacaggaaactatgccaaagtcacatccatcttgagaaggcctcagaggagctgtaaggaagctgaggggacctgctctcaagaggcatctccaggagagagacagaaacccaaacagatgtgactgtgatgagtaaaaatgagagaactcagacagcctaatcgggagcagcctcagtccattctgagcagaaaggaattggctgtctttctgaaattctgaaaatgagaaatttcaaac

SEQ ID NO: 286118 - DNA, 468 bp, Homo sapiens
gggccggggctcaggtgaggggcgcagcggggtggcagggcctcccctgctctcactggctgtgctggttgcaccctctgggagtgagtctcgtcgcaggcgtcagaacaaggcagtttttgcagtgctgtgtgaagggctcgtgtgttcatcctgggaatgacctcgtgagcactcactgtccctgaggactaggacagctcctagctggaagtaggtgccagtcagtcagggtgggcagcccacgttctgcacagtagcgtggccccacaagtgacgtgagcatcgctaccactgtgggagactgtgcatccacccgcgatcctgactgcatagctcgtctctcagacggaggcgccagcaccctccccgtggctgtttcttcagtacctccattttcctttcattggaattgcccttctggcattccctttttgttttcgtttttctttttttagagacggagtc

SEQ ID NO: 286119 - DNA, 201 bp, Homo sapiens
ttttaggagtcttctgcagagagaaaactcgggttgttgtttaatcatcagagacactcagttgtagctggagacatgaagacatataacagacacgtctataaacttcatcatgaaagctaccatgaaatgtattccaagaagtacaaaatgttcatctattgatatgttgacaagataacttttactcatagggtggga

SEQ ID NO: 286120 - DNA, 378 bp, Homo sapiens
tgttctatgcaaaagccttgataatgtctcctctgcctggccccagcttcctgagcccctaagctgaccctgtagggaagggtgggactttcagccctgctgagggtcacatcccctcccagctggagaggaacccagcccccacactcgggggaggaaacccagtgggaggtggcagggaagccacccacaggtttctaagtttagccccctgctacagaccactcccttcacccgcctccttggcccagagccaggcatgacctcatcctttgctctaagactccaccctgctggccactggcctgctttgtagacagggggccaggctggcaagcaacttggacatgaaaagagatgggacaccaagcacccaga

SEQ ID NO: 286121 - DNA, 534 bp, Homo sapiens
cctggaccgcatggtgcccatctccaagcagcccaaggagaagatccaggccatcatcgagtcctgcagccggcagttccctgagttccaggagcgggcccgcaagcgcatccgcacgtacctcaagtcctgccgtcgcatgaagaagaacggcatggagatgaccagacccacgccaccccatctgacctcggccatggcagaaaacatcctggcagctgcctgtgagagcgagacaagaaaggcagccaagcggatgcgtctagagatctaccagtcctcacaggatgagcccatagccctggacaagcagcactcgcgggactccgcagccatcacccactccacctactcactgccagcctcctcctactcccaggaccctgtgtacgccaacggcggcctcaactacagttaccgcgggtacggggccttgagcagcaacctgcagccccctgcctccctccaaacaggaaaccacagtaatgggcccacggacctcagcatgaaaggcggggcctctaccacctccac

SEQ ID NO: 286122 - DNA, 279 bp, Homo sapiens
ccacatcaagacaccatcacatctataatcctagcactttgggcagatcacctgagagctgagtgcagagcattcagaaaccaagacagaaagtcaacgccatctcctggaaaaaaaggaagggtggaaaacgttgaagctaagtggcattagagttaacttaaaccatgcactggttggcattcctggttctcccccttcctctctggccatgccatcccatcccaactgccgtgcatcctcctctatcttatcattaaatgctggcactcctcaagg

SEQ ID NO: 286123 - DNA, 941 bp, Homo sapiens
cgcacctcggcgcccaaggcccgtagccgcgcagtttcctcgggcgtcaggccgccgcgcagcccggccgtatacacgggccccgcgggctcgcagagcaggagcgcgcccgcctcagtccccgacggggcctcaatgcctggctcggcctgcagccgccgcagccagcggtcctgcagccccagtagctcggcgtacggcacccgacccaggcgcaccagccgaacggcgggttgccgcatcgtgcccaccgttgcgtccgcggggccccgccctctccgtgggcctgggggcgtggcctgaggggcggggactcgggggcacaccccgagccgcagctcccaggtgcgtgttaaaagctggaggggggatatgtgatcccaggaccaaaagcgcggggccagactcatcggttcattcaacaaccagtatttagtgcctgctgtgttctgcaggccctgccataggcgcttgatacagcggtgcatagcgtatgaaaaagatctgtcctggctgagcatccgtaatataaaaatctgaaatctgaaatgctccaaaatcctaaactttttgagtgctgacattatgccacaaatggaaaatttcatacctgaccttatgtgagttgcagtcaaaacacaggtgcacaacacccagttcatgcaacatccccaatgggaaaaaagacccccccagctctcttctgctgcagtttttctgctcacacctggatttccccatgcattcccacaaaaagtaattaaatggcatgcgtgcaggctggacacgccaacaacaggtttcccacaatgccccacatggggccaagacctgtgtgcattactcactgcatttttttgcttattctctgctgtgtggtataaatatattgttgaaaatgtcaaaaagacctaaagatacccctgtgaatatcagtgata

SEQ ID NO: 286124 - DNA, 5184 bp, Homo sapiens
tgtgcgccggggaggcgccggcttgtactcggcagcgcgggaataaagtttgctgatttggtgtctagcctggatgcctgggttgcaggcctgcttgtggtggcgctccacagtcatccggctgaaggagacctgttggactggatcttctcgggttttctttcagatattgttttgtatttacccatgaagacattgttttttggactttgcaaataggacatttcaaagatgagtgaaaaaaaattggaaacaactgcacagcagcggaaatgtcctgaatggatgaatgtgcagaataaaagatgtgctgtagaagaaagaaaggcatgtgttcggaagagtgtttttgaagatgacctccccttcttagaattcactggatccattgtgtatagttacgatgctagtgattgctctttcctgtcagaagatattagcatgagtctatcagatggggatgtggtgggatttgacatggagtggccaccattatacaatagagggaaacttggcaaagttgcactaattcagttgtgtgtttctgagagcaaatgttacttgttccacgtttcttccatgtcagtttttccccagggattaaaaatgttgcttgaaaataaagcagttaaaaaggcaggtgtaggaattgaaggagatcagtggaaacttctacgtgactttgatatcaaattgaagaattttgtggagttgacagatgttgccaataaaaagctgaaatgtacagagacctggagccttaacagtctggttaaacacctcttaggtaaacagctcctgaaagacaagtctatccgctgtagcaattggagtaaatttcctctcactgaggaccagaaactgtatgcagccactgatgcttatgctggttttattatttaccgaaatttagagattttggatgatactgtgcaaaggtttgctataaataaagaggaagaaatcctacttagcgacatgaacaaacagttgacttcaatctctgaggaagtgatggatctggctaagcatcttcctcatgctttcagtaaattggaaaacccacggagggtttctatcttactaaaggatatttcagaaaatctatattcactgaggaggatgataattgggtctactaacattgagactgaactgaggcccagcaataatttaaacttattatcctttgaagattcaactactgggggagtacaacagaaacaaattagagaacatgaagttttaattcacgttgaagatgaaacatgggacccaacacttgatcatttagctaaacatgatggagaagatgtacttggaaataaagtggaacgaaaagaagatggatttgaagatggagtagaagacaacaaattgaaagagaatatggaaagagcttgtttgatgtcgttagatattacagaacatgaactccaaattttggaacagcagtctcaggaagaatatcttagtgatattgcttataaatctactgagcatttatctcccaatgataatgaaaacgatacgtcctatgtaattgagagtgatgaagatttagaaatggagatgcttaagcatttatctcccaatgataatgaaaacgatacgtcctatgtaattgagagtgatgaagatttagaaatggagatgcttaagtctttagaaaacctcaatagtggcacggtagaaccaactcattctaaatgcttaaaaatggaaagaaatctgggtcttcctactaaagaagaagaagaagatgatgaaaatgaagctaatgaaggggaagaagatgatgataaggactttttgtggccagcacccaatgaagagcaagttacttgcctcaagatgtactttggccattccagttttaaaccagttcagtggaaagtgattcattcagtattagaagaaagaagagataatgttgctgtcatggcaactggatatggaaagagtttgtgcttccagtatccacctgtttatgtaggcaagattggccttgttatctctccccttatttctctgatggaagaccaagtgctacagcttaaaatgtccaacatcccagcttgcttccttggatcagcacagtcagaaaatgttctaacagatattaaattaggtaaataccggattgtatacgtaactccagaatactgttcaggtaacatgggcctgctccagcaacttgaggctgatattggtatcacgctcattgctgtggatgaggctcactgtatttctgagtgggggcatgattttagggattcattcaggaagttgggctccctaaagacagcactgccaatggttccaatcgttgcacttactgctactgcaagttcttcaatccgggaagacattgtacgttgcttaaatctgagaaatcctcagatcacctgtactggttttgatcgaccaaacctgtatttagaagttaggcgaaaaacagggaatatccttcaggatctgcagccatttcttgtcaaaacaagttcccactgggaatttgaaggtccaacaatcatctactgtccttctagaaaaatgacacaacaagttacaggtgaacttaggaaacttaatctatcctgtggaacataccatgcgggcatgagttttagcacaaggaaagacattcatcataggtttgtaagagatgaaattcagtgtgtcatagctaccatagcttttggaatgggcattaataaagctgacattcgccaagtcattcattacggtgctcctaaggacatggaatcatattatcaggagattggtagagctggtcgtgatggacttcaaagttcttgtcacgtcctctgggctcctgcagacattaacttaaataggcaccttcttactgagatacgtaatgagaagtttcgattatacaaattaaagatgatggcaaagatggaaaaatatcttcattctagcagatgtaggagacaaatcatcttgtctcattttgaggacaaacaagtacaaaaagcctccttgggaattatgggaactgaaaaatgctgtgataattgcaggtccagattggatcattgctattccatggatgactcagaggatacatcctgggactttggtccacaagcatttaagcttttgtctgctgtggacatcttaggcgaaaaatttggaattgggcttccaattttatttctccgaggatctaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaagggtagaaattggcttcataaagctaatacagaatctcagagcctcatccttcaagctaatgaagaattgtgtccaaagaagtttcttctgcctagttcgaaaactgtatcttcgggcaccaaagagcattgttataatcaagtaccagttgaattaagtacagagaagaagtctaacttggagaagttatattcttataaaccatgtgataagatttcttctgggagtaacatttctaaaaaaagtatcatggtacagtcaccagaaaaagcttacagttcctcacagcctgttatttcggcacaagagcaggagactcagattgtgttatatggcaaattggtagaagctaggcagaaacatgccaataaaatggatgttcccccagctattctggcaacaaacaagatactggtggatatggccaaaatgagaccaactacggttgaaaacgtaaaaaggattgatggtgtttctgaaggcaaagctgccatgttggcccctctgttggaagtcatcaaacatttctgccaaacaaatagtgttcagacagacctcttttcaagtacaaaacctcaagaagaacagaagacgagtctggtagcaaaaaataaaatatgcacactttcacagtctatggccatcacatactctttattccaagaaaagaagatgcctttgaagagcatagctgagagcaggattctgcctctcatgacaattggcatgcacttatcccaagcggtgaaagctggctgcccccttgatttggagcgagcaggcctgactccagaggttcagaagattattgctgatgttatccgaaaccctcccgtcaactcagatatgagtaaaattagcctaatcagaatgttagttcctgaaaacattgacacgtaccttatccacatggcaattgagatccttaaacatggtcctgacagcggacttcaaccttcatgtgatgtcaacaaaaggagatgttttcccggttctgaagagatctgttcaagttctaagagaagcaaggaagaagtaggcatcaatactgagacttcatctgcagagagaaagagacgattacctgtgtggtttgccaaaggaagtgataccagcaagaaattaatggacaaaacgaaaaggggaggtctttttagttaagctggcaattaccagaacaattatgtttcttgctgtattataagaggatagctatattttatttctgaagagtaaggagtagtattttggcttaaaaatcattctaattacaaagttcactgtttattgaagaactggcatcttaaatcagccttccgcaattcatgtagtttctgggtcttctgggagcctacgtgagtacatcacctaacagaatattaaattagacttcctgtaagattgctttaagaaactgttactgtcctgttttctaatctctttattaaaacagtgtatttggaaaatgttatgtgctctgatttgatatagataacagattagtagttacatggtaattatgtgatataaaatattcatatattatcaaaattctgttttgtaaatgtaagaaagcatagttattttacaaattgtttttactgtcttttgaagaagttcttaaatacgttgttaaatggtattagttgaccagggcagtgaaaatgaaaccgcattttgggtgccattaaatagggaaaaaacatgtaaaaaatgtaaaatggagaccaattgcactaggcaagtgtatattttgtattttatatacaatttctattatttttcaagtaataaaacaatgtttttcatactgaa

SEQ ID NO: 286125 - DNA, 5445 bp, Homo sapiens
tgtgcgccggggaggcgccggcttgtactcggcagcgcgggaataaagtttgctgatttggtgtctagcctggatgcctgggttgcaggcctgcttgtggtggcgctccacagtcatccggctgaaggagacctgttggactggatcttctcgggttttctttcagatattgttttgtatttacccatgaagacattgttttttggactttgcaaataggacatttcaaagatgagtgaaaaaaaattggaaacaactgcacagcagcggaaatgtcctgaatggatgaatgtgcagaataaaagatgtgctgtagaagaaagaaaggcatgtgttcggaagagtgtttttgaagatgacctccccttcttagaattcactggatccattgtgtatagttacgatgctagtgattgctctttcctgtcagaagatattagcatgagtctatcagatggggatgtggtgggatttgacatggagtggccaccattatacaatagagggaaacttggcaaagttgcactaattcagttgtgtgtttctgagagcaaatgttacttgttccacgtttcttccatgtcagtttttccccagggattaaaaatgttgcttgaaaataaagcagttaaaaaggcaggtgtaggaattgaaggagatcagtggaaacttctacgtgactttgatatcaaattgaagaattttgtggagttgacagatgttgccaataaaaagctgaaatgtacagagacctggagccttaacagtctggttaaacacctcttaggtaaacagctcctgaaagacaagtctatccgctgtagcaattggagtaaatttcctctcactgaggaccagaaactgtatgcagccactgatgcttatgctggttttattatttaccgaaatttagagattttggatgatactgtgcaaaggtttgctataaataaagaggaagaaatcctacttagcgacatgaacaaacagttgacttcaatctctgaggaagtgatggatctggctaagcatcttcctcatgctttcagtaaattggaaaacccacggagggtttctatcttactaaaggatatttcagaaaatctatattcactgaggaggatgataattgggtctactaacattgagactgaactgaggcccagcaataatttaaacttattatcctttgaagattcaactactgggggagtacaacagaaacaaattagagaacatgaagttttaattcacgttgaagatgaaacatgggacccaacacttgatcatttagctaaacatgatggagaagatgtacttggaaataaagtggaacgaaaagaagatggatttgaagatggagtagaagacaacaaattgaaagagaatatggaaagagcttgtttgatgtcgttagatattacagaacatgaactccaaattttggaacagcagtctcaggaagaatatcttagtgatattgcttataaatctactgagcatttatctcccaatgataatgaaaacgatacgtcctatgtaattgagagtgatgaagatttagaaatggagatgcttaagcatttatctcccaatgataatgaaaacgatacgtcctatgtaattgagagtgatgaagatttagaaatggagatgcttaagtctttagaaaacctcaatagtggcacggtagaaccaactcattctaaatgcttaaaaatggaaagaaatctgggtcttcctactaaagaagaagaagaagatgatgaaaatgaagctaatgaaggggaagaagatgatgataaggactttttgtggccagcacccaatgaagagcaagttacttgcctcaagatgtactttggccattccagttttaaaccagttcagtggaaagtgattcattcagtattagaagaaagaagagataatgttgctgtcatggcaactggatatggaaagagtttgtgcttccagtatccacctgtttatgtaggcaagattggccttgttatctctccccttatttctctgatggaagaccaagtgctacagcttaaaatgtccaacatcccagcttgcttccttggatcagcacagtcagaaaatgttctaacagatattaaattaggtaaataccggattgtatacgtaactccagaatactgttcaggtaacatgggcctgctccagcaacttgaggctgatattggtatcacgctcattgctgtggatgaggctcactgtatttctgagtgggggcatgattttagggattcattcaggaagttgggctccctaaagacagcactgccaatggttccaatcgttgcacttactgctactgcaagttcttcaatccgggaagacattgtacgttgcttaaatctgagaaatcctcagatcacctgtactggttttgatcgaccaaacctgtatttagaagttaggcgaaaaacagggaatatccttcaggatctgcagccatttcttgtcaaaacaagttcccactgggaatttgaaggtccaacaatcatctactgtccttctagaaaaatgacacaacaagttacaggtgaacttaggaaacttaatctatcctgtggaacataccatgcgggcatgagttttagcacaaggaaagacattcatcataggtttgtaagagatgaaattcagtgtgtcatagctaccatagcttttggaatgggcattaataaagctgacattcgccaagtcattcattacggtgctcctaaggacatggaatcatattatcaggagattggtagagctggtcgtgatggacttcaaagttcttgtcacgtcctctgggctcctgcagacattaacttaaataggcaccttcttactgagatacgtaatgagaagtttcgattatacaaattaaagatgatggcaaagatggaaaaatatcttcattctagcagatgtaggagacaaatcatcttgtctcattttgaggacaaacaagtacaaaaagcctccttgggaattatgggaactgaaaaatgctgtgataattgcaggtccagattggatcattgctattccatggatgactcagaggatacatcctgggactttggtccacaagcatttaagcttttgtctgctgtggacatcttaggcgaaaaatttggaattgggcttccaattttatttctccgaggatctaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaagggtagaaattggcttcataaagctaatacagaatctcagagcctcatccttcaagctaatgaagaattgtgtccaaagaagtttcttctgcctagttcgaaaactgtatcttcgggcaccaaagagcattgttataatcaagtaccagttgaattaagtacagagaagaagtctaacttggagaagttatattcttataaaccatgtgataagatttcttctgggagtaacatttctaaaaaaagtatcatggtacagtcaccagaaaaagcttacagttcctcacagcctgttatttcggcacaagagcaggagactcagattgtgttatatggcaaattggtagaagctaggcagaaacatgccaataaaatggatgttcccccagctattctggcaacaaacaagatactggtggatatggccaaaatgagaccaactacggttgaaaacgtaaaaaggattgatggtgtttctgaaggcaaagctgccatgttggcccctctgttggaagtcatcaaacatttctgccaaacaaatagtgttcagacagacctcttttcaagtacaaaacctcaagaagaacagaagacgagtctggtagcaaaaaataaaatatgcacactttcacagtctatggccatcacatactctttattccaagaaaagaagatgcctttgaagagcatagctgagagcaggattctgcctctcatgacaattggcatgcacttatcccaagcggtgaaagctggctgcccccttgatttggagcgagcaggcctgactccagaggttcagaagattattgctgatgttatccgaaaccctcccgtcaactcagatatgagtaaaattagcctaatcagaatgttagttcctgaaaacattgacacgtaccttatccacatggcaattgagatccttaaacatggtcctgacagcggacttcaaccttcatgtgatgtcaacaaaaggagatgttttcccggttctgaagagatctgttcaagttctaagagaagcaaggaagaagtaggcatcaatactgagacttcatctgcagagagaaagagacgattacctgtgtggtttgccaaaggaagtgataccagcaagaaattaatggacaaaacgaaaaggggaggtctttttagttaagctggcaattaccagaacaattatgtttcttgctgtattataagaggatagctatattttatttctgaagagtaaggagtagtattttggcttaaaaatcattctaattacaaagttcactgtttattgaagaactggcatcttaaatcagccttccgcaattcatgtagtttctgggtcttctgggagcctacgtgagtacatcacctaacagaatattaaattagacttcctgtaagattgctttaagaaactgttactgtcctgttttctaatctctttattaaaacagtgtatttggaaaatgttatgtgctctgatttgatatagataacagattagtagttacatggtaattatgtgatataaaatattcatatattatcaaaattctgttttgtaaatgtaagaaagcatagttattttacaaattgtttttactgtcttttgaagaagttcttaaatacgttgttaaatggtattagttgaccagggcagtgaaaatgaaaccgcattttgggtgccattaaatagggaaaaaacatgtaaaaaatgtaaaatggagaccaattgcactaggcaagtgtatattttgtattttatatacaatttctattatttttcaagtaataaaacaatgtttttcatactgaatattatatatatattttttagctttcatttacttaattattttaagtacctttatttttccaggatgtcagaatttgattctaatctctcttatgtagcacatgtgacttaatttaaaacctatactgtgacacagagttgggtaaacgatgattatttaactttaagcagttcaccatccatttcaaagcctttgattggcttttttgtaaataaaaataacttgttaagaaacaaatatatctgtcatagaagaactag

SEQ ID NO: 286126 - DNA, 4481 bp, Homo sapiens
tgtgcgccggggaggcgccggcttgtactcggcagcgcgggaataaagtttgctgatttggtgtctagcctggatgcctgggttgcaggcctgcttgtggtggcgctccacagtcatccggctgaaggagacctgttggactggatcttctcgggttttctttcagatattgttttgtatttacccatgaagacattgttttttggactttgcaaataggacatttcaaagatgagtgaaaaaaaattggaaacaactgcacagcagcggaaatgtcctgaatggatgaatgtgcagaataaaagatgtgctgtagaagaaagaaaggcatgtgttcggaagagtgtttttgaagatgacctccccttcttagaattcactggatccattgtgtatagttacgatgctagtgattgctctttcctgtcagaagatattagcatgagtctatcagatggggatgtggtgggatttgacatggagtggccaccattatacaatagagggaaacttggcaaagttgcactaattcagttgtgtgtttctgagagcaaatgttacttgttccacgtttcttccatgtcagtttttccccagggattaaaaatgttgcttgaaaataaagcagttaaaaaggcaggtgtaggaattgaaggagatcagtggaaacttctacgtgactttgatatcaaattgaagaattttgtggagttgacagatgttgccaataaaaagctgaaatgtacagagacctggagccttaacagtctggttaaacacctcttaggtaaacagctcctgaaagacaagtctatccgctgtagcaattggagtaaatttcctctcactgaggaccagaaactgtatgcagccactgatgcttatgctggttttattatttaccgaaatttagagattttggatgatactgtgcaaaggtttgctataaataaagaggaagaaatcctacttagcgacatgaacaaacagttgacttcaatctctgaggaagtgatggatctggctaagcatcttcctcatgctttcagtaaattggaaaacccacggagggtttctatcttactaaaggatatttcagaaaatctatattcactgaggaggatgataattgggtctactaacattgagactgaactgaggcccagcaataatttaaacttattatcctttgaagattcaactactgggggagtacaacagaaacaaattagagaacatgaagttttaattcacgttgaagatgaaacatgggacccaacacttgatcatttagctaaacatgatggagaagatgtacttggaaataaagtggaacgaaaagaagatggatttgaagatggagtagaagacaacaaattgaaagagaatatggaaagagcttgtttgatgtcgttagatattacagaacatgaactccaaattttggaacagcagtctcaggaagaatatcttagtgatattgcttataaatctactgagcatttatctcccaatgataatgaaaacgatacgtcctatgtaattgagagtgatgaagatttagaaatggagatgcttaagcatttatctcccaatgataatgaaaacgatacgtcctatgtaattgagagtgatgaagatttagaaatggagatgcttaagtctttagaaaacctcaatagtggcacggtagaaccaactcattctaaatgcttaaaaatggaaagaaatctgggtcttcctactaaagaagaagaagaagatgatgaaaatgaagctaatgaaggggaagaagatgatgataaggactttttgtggccagcacccaatgaagagcaagttacttgcctcaagatgtactttggccattccagttttaaaccagttcagtggaaagtgattcattcagtattagaagaaagaagagataatgttgctgtcatggcaactggatatggaaagagtttgtgcttccagtatccacctgtttatgtaggcaagattggccttgttatctctccccttatttctctgatggaagaccaagtgctacagcttaaaatgtccaacatcccagcttgcttccttggatcagcacagtcagaaaatgttctaacagatattaaattaggtaaataccggattgtatacgtaactccagaatactgttcaggtaacatgggcctgctccagcaacttgaggctgatattggtatcacgctcattgctgtggatgaggctcactgtatttctgagtgggggcatgattttagggattcattcaggaagttgggctccctaaagacagcactgccaatggttccaatcgttgcacttactgctactgcaagttcttcaatccgggaagacattgtacgttgcttaaatctgagaaatcctcagatcacctgtactggttttgatcgaccaaacctgtatttagaagttaggcgaaaaacagggaatatccttcaggatctgcagccatttcttgtcaaaacaagttcccactgggaatttgaaggtccaacaatcatctactgtccttctagaaaaatgacacaacaagttacaggtgaacttaggaaacttaatctatcctgtggaacataccatgcgggcatgagttttagcacaaggaaagacattcatcataggtttgtaagagatgaaattcagtgtgtcatagctaccatagcttttggaatgggcattaataaagctgacattcgccaagtcattcattacggtgctcctaaggacatggaatcatattatcaggagattggtagagctggtcgtgatggacttcaaagttcttgtcacgtcctctgggctcctgcagacattaacttaaataggcaccttcttactgagatacgtaatgagaagtttcgattatacaaattaaagatgatggcaaagatggaaaaatatcttcattctagcagatgtaggagacaaatcatcttgtctcattttgaggacaaacaagtacaaaaagcctccttgggaattatgggaactgaaaaatgctgtgataattgcaggtccagattggatcattgctattccatggatgactcagaggatacatcctgggactttggtccacaagcatttaagcttttgtctgctgtggacatcttaggcgaaaaatttggaattgggcttccaattttatttctccgaggatctaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaagggtagaaattggcttcataaagctaatacagaatctcagagcctcatccttcaagctaatgaagaattgtgtccaaagaagtttcttctgcctagttcgaaaactgtatcttcgggcaccaaagagcattgttataatcaagtaccagttgaattaagtacagagaagaagtctaacttggagaagttatattcttataaaccatgtgataagatttcttctgggagtaacatttctaaaaaaagtatcatggtacagtcaccagaaaaagcttacagttcctcacagcctgttatttcggcacaagagcaggagactcagattgtgttatatggcaaattggtagaagctaggcagaaacatgccaataaaatggatgttcccccagctattctggcaacaaacaagatactggtggatatggccaaaatgagaccaactacggttgaaaacgtaaaaaggattgatggtgtttctgaaggcaaagctgccatgttggcccctctgttggaagtcatcaaacatttctgccaaacaaatagtgttcagacagacctcttttcaagtacaaaacctcaagaagaacagaagacgagtctggtagcaaaaaataaaatatgcacactttcacagtctatggccatcacatactctttattccaagaaaagaagatgcctttgaagagcatagctgagagcaggattctgcctctcatgacaattggcatgcacttatcccaagcggtgaaagctggctgcccccttgatttggagcgagcaggcctgactccagaggttcagaagattattgctgatgttatccgaaaccctcccgtcaactcaggtgagaggcatggcctagctctgcacccttaatgacttgatgaagtaaacaagcaatccactatatttttcactgttaacagcattaatcctttatgctattatgaaaaccttacttttgtgattctttttcttgttttaggaaaacaatctttcttcccattatcactcagaggaaagtatactgagaaatttttttgttttgttttgttttttgagacagagtcttgcttccagcctgagtgacacccagagtgagaacctgtctc

SEQ ID NO: 286127 - DNA, 341 bp, Homo sapiens
ttattgaagtatgcagaatgtaaatgaattgtttttataactttggcacttgctgtatcttagaacattcttttgatgatttattttctgtagttttgggagagataagacattggaatgcgtttctaactacctttagaactttagaaactgataatttaggaggttattttcaggtgattaatttgacagcttgattaggcaaagaaaaaattgtgattttgagatttttgtttcttattttcttcacatttaaaagttttttgaaactttttttaatggacctttatatgtttaaatgcagtctaacttggagaagttatattcttataaaccatgtg

SEQ ID NO: 286128 - DNA, 390 bp, Homo sapiens
ggtgatctttagcatactttttaaatttttctgtttttttataggctggttttattatttaccgaaatttagagattttggatgatactgtgcaaaggtttgctataaataaaggtatgttaagatccataaataaaatgtgaattcactcttttgtgaggtttatctccaaaaaaggcaatattcacatatttgcaaagcatttagtactataacttcttgaatgtctgagcagtcctgacattagggtgggatccatcagggcccaagatgagtgtttcatctttgttacttgtggcaaagcagcccttacttcttttactttgtagcattgctatgtatttggcttctagagttggggctttgtggctttcttattgcagtgacaca

SEQ ID NO: 286129 - DNA, 360 bp, Homo sapiens
aatgtaaggttttcattctgctaaatatgtttgtcaaactgtgttgtgatttgttctcagtgtgtcatagctaccatagcttttggaatgggcattaataaagctgacattcgccaagtcattcattacggtgctcctaaggacatggaatcatattatcaggagattggtagagctggtcgtgatggacttcaaagttcttgtcacgtcctctgggctcctgcagacattaacttaaataggtaaaaaaaatttattgtttttactcttgcagatttctttctttctttccatataaacctcaaaagtgtttgaggctatttccagtatcccaagtaatttgtgagtgcatttaaagta

SEQ ID NO: 286130 - DNA, 384 bp, Homo sapiens
aatagtttattttcatattttagctactttacatactcgggtataatgaactttattcatagcttctgaagcagttggcacatttgagatattttttacttggctaattgttatgctaaatcttttgatttctaaagatacatgcctttgctaagctttcttcaaatgttattatttttatttagattggatcattgctattccatggatgactcagaggatacatcctgggactttggtccacaagcatttaagcttttgtctgctgtggacatcttaggcgaaaaatttggaattgggcttccaattttatttctccgaggatctgtaagtatatatctgtgaattcccttcatagatcttcttttacttctattacacttt

SEQ ID NO: 286131 - DNA, 204 bp, Homo sapiens
gaaaagaactgtggtaagtaaagagtttgatgacttatgcattttgttaaaatatgatgttatcttagtctgcaaatgtattgagattctgaaaataaaatccacttctaacaattgctttgaaagaatctatacttctctgtgtaaaggaataaaattgaatgtttgacgtggggttatcaacttgagaatggaatgataagg

SEQ ID NO: 286132 - DNA, 454 bp, Homo sapiens
aattttgagaagcagtttgagctcatttcctgcatgtttagttctaggtgcaatgttttaaggggaagacttacactatgaagctagcccagaagagggtgactagagtactgaggagtttctacctggaagggctgtaaggaagacaactgctatgttgtgagcggctctatggagaggcccatgtggagggaagtgaggaaggcctctgcaaacagtccaggaggaagtgaagccctcagtccaacagcctgtgtggaactgaaccctgcaaacaactctgtgtgtgagcttggaagtggatccatattcagtcaaaccttgagatgggacaccatgctctgctaacacttgattgtggtcccagctaggccactgctgaagtcttgactcagagaaacgatgatatagtaaatgtttgttgtttcaagttggtaagttttgggataatttt

SEQ ID NO: 286133 - DNA, 657 bp, Homo sapiens
tcggtgaggcgggtcctacggtatgcagacagtttcgacactttggactcagcgcacctcggccgaatctcgatgtctatcaacatgcgagacattgtagtaatagctctactcgcaatccttcgaactctcatagacatcctgatatgctgctcatgtgagcctgtgtctattgttgcttctacctgtttgctctcccacatcctgcggctgcatgtgaagctgcaggcccctcctagcattactcataaatgctgtcgttggttagcgagtacactgggccgtcgttttttacaaacgtcttgcactgggaaacacctgtcgttacccaactattgtcgccttgcatctacatccccctttcgcatcgcgcctggtgggatggggtggctgatacccaattcctcctcctgggcctgctgccttctcagggccacctggaagcacacgacaatgagtcatcctccagcactccagaatcagctttgccaaaacacagaagccccacccatcccagacaccatgattcactagctctggaggttcaagtcacagtgtactctggcaggaaggcactgtgctagcacagcgaacacattgctctgcagagaatctgctctcctccagtcggatggaatccctctgttgcacatccca

SEQ ID NO: 286134 - DNA, 1676 bp, Homo sapiens
gcggcaacccgccgttcggctggtgcgcctgggtcgggtgccgtacgccgagctactggggctgcaggaccgctggctgcggcggctgcaggccgagccaggcattgaggccccgtcggggactgaggcgggcgcgctcctgctctgcgagcccgcggggcccgtgtatacggccgggctgcgcggcggcctgacgcccgaggaaactgcgcggctacgggccttgggcgccgaggtgcgcgtcacaggccgcggtggcctggccaccttccacggcccgggccagctgctttgccacccggtactcgacctgcggcgtctcggcctgcgcttgcgcatgcacgtagcgtcgctggaggcgtgcgccgtgcgcctgtgcgagctccagggcctgcaggacgcccgcgcgcggcccccgccctacactggcgtctggctagacgatcgcaagatctgcgcgatcggagtccgctgtggaaggcacatcacatcccacggcctggctctcaactgctctaccgacctcacgtggtttgagcacatcgtgccctgtggactggttgggtcaggcgtcacttccttgagtaaggagctccagaggcacgtcaccgtggaagaagtaatgccacctttccttgtggcctttaaggagatctacaagtgcacactgatctcagaggacagccccaactgaagagtactcataacagccaggatgctcctgccttgggaagcatgaagtctgacttgagtcacctactgaaacccagattttagacctggcctgtcattcactgatcatgaaactaaggacataccatgagctctgagccactattttcatatgtatcctgttttatttatatctttcccacctacctcagagatactagatgtgacaatactgtgaaaagcaacacatgctatataaaacattagcactgctattgacagaagtgtctcagagaaattcagatgtcatagattgttatttctcgattgttgatgtcatagattgtcatttctcgattgttgcttcctcaatactgtgtctaactgagcaattctgggctctagttcctttgattttgtgggaatcaaatctctgaatggcccaggtgaaggtgatgtgatgtagtgctttttcattctcaagagacctgggttctttctgcaataaagggaaaagggaagaaccttctaagaataaaatgggatcttaccttcctgggtttgattccccaagtttgataatttagcagtttttagttgggttaccctgagctaggccaaagactggaggaaggataagaataatttctcacactgtacaaatgccaaagatagaagtgagtttttcttatatgagacctctaaatttgtaaggctgcgtattatctgttgctgtgtaacaaatcatcaaaacttagtgacttaacagtaaacattaattatctcgtttgtgggtcaggaatttgggggaagcttagctgggtgtttctaggttagggtctcacacgaacttgcagttaagatgtcagctggaactgcacttattcaaaggcttggctgggctggaggatcagcgctccatatggtgcattcacttgcgtggttggttatggttgctgacaagaggcctcagttccttaccgtgtggacctccctatagggtt

SEQ ID NO: 286135 - DNA, 1714 bp, Homo sapiens
gcggcaacccgccgttcggctggtgcgcctgggtcgggtgccgtacgccgagctactggggctgcaggaccgctggctgcggcggctgcaggccgagccaggcattgaggccccgtcggggactgaggcgggcgcgctcctgctctgcgagcccgcggggcccgtgtatacggccgggctgcgcggcggcctgacgcccgaggaaactgcgcggctacgggccttgggcgccgaggtgcgcgtcacaggccgcggtggcctggccaccttccacggcccgggccagctgctttgccacccggtactcgacctgcggcgtctcggcctgcgcttgcgcatgcacgtagcgtcgctggaggcgtgcgccgtgcgcctgtgcgagctccagggcctgcaggacgcccgcgcgcggcccccgccctacactggcgtctggctagacgatcgcaagatctgcgcgatcggtgagcgccgcggcgcagggcggtacctgagagccgaggagtccgctgtggaaggcacatcacatcccacggcctggctctcaactgctctaccgacctcacgtggtttgagcacatcgtgccctgtggactggttgggtcaggcgtcacttccttgagtaaggagctccagaggcacgtcaccgtggaagaagtaatgccacctttccttgtggcctttaaggagatctacaagtgcacactgatctcagaggacagccccaactgaagagtactcataacagccaggatgctcctgccttgggaagcatgaagtctgacttgagtcacctactgaaacccagattttagacctggcctgtcattcactgatcatgaaactaaggacataccatgagctctgagccactattttcatatgtatcctgttttatttatatctttcccacctacctcagagatactagatgtgacaatactgtgaaaagcaacacatgctatataaaacattagcactgctattgacagaagtgtctcagagaaattcagatgtcatagattgttatttctcgattgttgatgtcatagattgtcatttctcgattgttgcttcctcaatactgtgtctaactgagcaattctgggctctagttcctttgattttgtgggaatcaaatctctgaatggcccaggtgaaggtgatgtgatgtagtgctttttcattctcaagagacctgggttctttctgcaataaagggaaaagggaagaaccttctaagaataaaatgggatcttaccttcctgggtttgattccccaagtttgataatttagcagtttttagttgggttaccctgagctaggccaaagactggaggaaggataagaataatttctcacactgtacaaatgccaaagatagaagtgagtttttcttatatgagacctctaaatttgtaaggctgcgtattatctgttgctgtgtaacaaatcatcaaaacttagtgacttaacagtaaacattaattatctcgtttgtgggtcaggaatttgggggaagcttagctgggtgtttctaggttagggtctcacacgaacttgcagttaagatgtcagctggaactgcacttattcaaaggcttggctgggctggaggatcagcgctccatatggtgcattcacttgcgtggttggttatggttgctgacaagaggcctcagttccttaccgtgtggacctccctatagggtt

SEQ ID NO: 286136 - DNA, 1308 bp, Homo sapiens
ggtgatctaatccagttttctcatcgccctgagagggacaccaaagcccggagagtggagggtatctactctaagaccctttggcttgccttgcaggagtccgctgtggaaggcacatcacatcccacggcctggctctcaactgctctaccgacctcacgtggtttgagcacatcgtgccctgtggactggttgggtcaggcgtcacttccttgagtaaggagctccagaggcacgtcaccgtggaagaagtaatgccacctttccttgtggcctttaaggagatctacaagtgcacactgatctcagaggacagccccaactgaagagtactcataacagccaggatgctcctgccttgggaagcatgaagtctgacttgagtcacctactgaaacccagattttagacctggcctgtcattcactgatcatgaaactaaggacataccatgagctctgagccactattttcatatgtatcctgttttatttatatctttcccacctacctcagagatactagatgtgacaatactgtgaaaagcaacacatgctatataaaacattagcactgctattgacagaagtgtctcagagaaattcagatgtcatagattgttatttctcgattgttgatgtcatagattgtcatttctcgattgttgcttcctcaatactgtgtctaactgagcaattctgggctctagttcctttgattttgtgggaatcaaatctctgaatggcccaggtgaaggtgatgtgatgtagtgctttttcattctcaagagacctgggttctttctgcaataaagggaaaagggaagaaccttctaagaataaaatgggatcttaccttcctgggtttgattccccaagtttgataatttagcagtttttagttgggttaccctgagctaggccaaagactggaggaaggataagaataatttctcacactgtacaaatgccaaagatagaagtgagtttttcttatatgagacctctaaatttgtaaggctgcgtattatctgttgctgtgtaacaaatcatcaaaacttagtgacttaacagtaaacattaattatctcgtttgtgggtcaggaatttgggggaagcttagctgggtgtttctaggttagggtctcacacgaacttgcagttaagatgtcagctggaactgcacttattcaaaggcttggctgggctggaggatcagcgctccatatggtgcattcacttgcgtggttggttatggttgctgacaagaggcctcagttccttaccgtgtggacctccctatagggtt

SEQ ID NO: 286137 - DNA, 860 bp, Homo sapiens
gcggcaacccgccgttcggctggtgcgcctgggtcgggtgccgtacgccgagctactggggctgcaggaccgctggctgcggcggctgcaggccgagccaggcattgaggccccgtcggggactgaggcgggcgcgctcctgctctgcgagcccgcggggcccgtgtatacggccgggctgcgcggcggcctgacgcccgaggaaactgcgcggctacgggccttgggcgccgaggtgcgcgtcacaggccgcggtggcctggccaccttccacggcccgggccagctgctttgccacccggtactcgacctgcggcgtctcggcctgcgcttgcgcatgcacgtagcgtcgctggaggcgtgcgccgtgcgcctgtgcgagctccagggcctgcaggacgcccgcgcgcggcccccgccctacactggcgtctggctagacgatcgcaagatctgcgcgatcggtgagcgccgcggcgcagggcggtacctgagagccgaggtcggagcttgaggcctgggggcggggtctgacggggctggaccaatggaggtgagggccgggaggaggcgtatctagcgcgggttttgaatcacagctacccgctgcgtttgagtttttaagccccttttcagatatcgtatattcagaagcagaaggctcctcacatctagtccaacacgcatttctgtgaagggagagacaagagaagtgaattgccaggttacgtcctgcgaatgacaatgtcatggcaaataagggtgctaattttcaaacttttttttttttttttttgagacagagtctcgctttgtcacccaggctggagtgcagtggcgcaatctcggcccactgcaag

SEQ ID NO: 286138 - DNA, 397 bp, Homo sapiens
gcggccgctaccccgaccactcggtggacaggagagaaggttcaaggtcaatgatgggagaacgagaaggacaggtaagtctgaagctacagtggtagccacagaatttcccatagaatgggttcttttcccttcagcgtgccttcttcctgccctttctttgagcaagaggcaaaatgaggaaagagaaaagtaaagcactagaaaagtctaggtttgtggaatggaaatttgggattatttggggttagtcttggctgtcagtccaaacagttactctgaagctgtttttagccttgaccctggggttctgtgtgccacactcaccacacatgtgcaacagtgccagggaaccttgggatgtgacctggctctgctgggaagtgtctagtgagcc

SEQ ID NO: 286139 - DNA, 3313 bp, Homo sapiens
ggcgccttcctggagcgcggggagatgtaaagatagacaaataattttcccaatgagactgtagaagagagagcaattggccaatgaggactgcggggcgggaccctgtgccgcggcggagtccaagatggcggcgtgcggttccgctgtgtgaaacgagcgcggggcggcgggttactcagctccgcggagacgacctccgacgacccgcaacaatgaagggaaaagagcgctcgccagtgaaggccaaacgctcccgtggtggtgaggactcgacttcccgcggtgagcggagcaagaagttagggggctctggtggcagcaatgggagcagcagcggaaagaccgatagcggcggtgggtcgcggcggagtctcctcctggacaagtccagcagtcgaggtggcagccgcgagtatgataccggtgggggcagctccagtagccgcttgcatagttatagctccccgagcaccaaaaattcttcgggcgggggcgagtcgcgcagcagctcccggggtggaggcggggagtcacgttcctctggggccgcctcctcagctcccggcggcggggacggcgcggaatacaagactctgaagataagcgagttggggtcccagcttagtgacgaagcggtggaggacggcctgtttcatgagttcaaacgcttcggtgatgtaagtgtgaaaatcagtcatctgtcgggttctggcagcggggatgagcgggtagcctttgtgaacttccggcggccagaggacgcgcgggcggccaagcatgccagaggccgcctggtgctctatgaccggcctctgaagatagaagctgtgtatgtgagccggcgccgcagccgctcccctttagacaaagatacttatcctccatcagccagtgtggtcggggcctctgtaggtggtcaccggcacccccctggaggtggtggaggccagagatcactttcccctggtggcgctgctttgggatacagagactaccggctgcagcagttggctcttggccgcctgccccctccacctccgccaccattgcctcgagacctggagagagaaagagactacccgttctatgagagagtgcgccctgcatacagtcttgagccaagggtgggagctggagcaggtgctgctcctttcagagaagtggatgagatttcacccgaggatgatcagcgagctaaccggacgctcttcttgggcaacctagacatcactgtaacggagagtgatttaagaagggcgtttgatcgctttggagtcatcacagaagtagatatcaagaggccttctcgcggccagactagtacttacggctttctcaaatttgagaacttagatatgtctcaccgggccaaattagcaatgtctggcaaaattataattcggaatcctatcaaaattggttatggtaaagctacacccaccacccgcctctgggtgggaggcctgggaccttgggttcctcttgctgccctggcacgagaatttgatcgatttggcaccatacgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttatgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacggacgaggtagtttggagaagagccagggtgacaagcgagaccgtaaaaactctgcatcagctgaacgagataggaagcaccggacaactgctcccactgagggaaaaagccctctgaaaaaagaagaccgctctgatgggagtgcacctagcaccagcactgcttcctccaagctgaagtccccgtcccagaaacaggatggggggacagcccctgtggcatcagcctctcccaaactctgtttggcctggcagggcatgcttctactgaagaacagcaactttccttccaacatgcatctgttgcagggtgacctccaagtggctagtagtcttcttgtggagggttcaactggaggcaaagtggcccagctcaagatcactcagcgtctccgtttggaccagcccaagttggatgaagtaactcgacgcatcaaagtagcagggcccaatggttatgccattcttttggctgtgcctggaagttctgacagccggtcctcctcttcctcagctgcatcagacactgccacttctactcagaggccacttaggaaccttgtgtcctatttaaagcaaaagcaggcagccggggtgatcagcctccctgtggggggcaacaaagacaaggaaaacaccggggtccttcatgccttcccaccttgtgagttctcccagcagttcctggattcccctgccaaggcactggccaaatctgaagaagattacctggtcatgatcattgtccgtgcaaaactggttgaacagcggatgaagatatggaattcaaagctctaatggacctttttgaagagaagttgtggcttatgtggagtttacatgggcctctgatggaagaaagctaatctgtttagtatttgtgcattttactaaaatggcagcttaaagttgtgtatctgctattgtgatgccaatgccggtgttttaagtggaaaaaaaatgacctctttgatttgtgctgtgtacacaagatttctggaaaagtaaagaaaaaccctttttatggctcacacagcttaagagtagctgtctctcaaacgtgcgctcacagttgagctgcttttgttttattctaaataaattgtttcttttgagga

SEQ ID NO: 286140 - DNA, 3424 bp, Homo sapiens
ggcgccttcctggagcgcggggagatgtaaagatagacaaataattttcccaatgagactgtagaagagagagcaattggccaatgaggactgcggggcgggaccctgtgccgcggcggagtccaagatggcggcgtgcggttccgctgtgtgaaacgagcgcggggcggcgggttactcagctccgcggagacgacctccgacgacccgcaacaatgaagggaaaagagcgctcgccagtgaaggccaaacgctcccgtggtggtgaggactcgacttcccgcggtgagcggagcaagaagttagggggctctggtggcagcaatgggagcagcagcggaaagaccgatagcggcggtgggtcgcggcggagtctcctcctggacaagtccagcagtcgaggtggcagccgcgagtatgataccggtgggggcagctccagtagccgcttgcatagttatagctccccgagcaccaaaaattcttcgggcgggggcgagtcgcgcagcagctcccggggtggaggcggggagtcacgttcctctggggccgcctcctcagctcccggcggcggggacggcgcggaatacaagactctgaagataagcgagttggggtcccagcttagtgacgaagcggtggaggacggcctgtttcatgagttcaaacgcttcggtgatgtaagtgtgaaaatcagtcatctgtcgggttctggcagcggggatgagcgggtagcctttgtgaacttccggcggccagaggacgcgcgggcggccaagcatgccagaggccgcctggtgctctatgaccggcctctgaagatagaagctgtgtatgtgagccggcgccgcagccgctcccctttagacaaagatacttatcctccatcagccagtgtggtcggggcctctgtaggtggtcaccggcacccccctggaggtggtggaggccagagatcactttcccctggtggcgctgctttgggatacagagactaccggctgcagcagttggctcttggccgcctgccccctccacctccgccaccattgcctcgagacctggagagagaaagagactacccgttctatgagagagtgcgccctgcatacagtcttgagccaagggtgggagctggagcaggtgctgctcctttcagagaagtggatgagatttcacccgaggatgatcagcgagctaaccggacgctcttcttgggcaacctagacatcactgtaacggagagtgatttaagaagggcgtttgatcgctttggagtcatcacagaagtagatatcaagaggccttctcgcggccagactagtacttacggctttctcaaatttgagaacttagatatgtctcaccgggccaaattagcaatgtctggcaaaattataattcggaatcctatcaaaattggttatggtaaagctacacccaccacccgcctctgggtgggaggcctgggaccttgggttcctcttgctgccctggcacgagaatttgatcgatttggcaccatacgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttatgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacggacgaggtagtttggagaagagccagggtgacaagcgagaccgtaaaaactctgcatcagctgaacgagataggaagcaccggacaactgctcccactgagggaaaaagccctctgaaaaaagaagaccgctctgatgggagtgcacctagcaccagcactgcttcctccaagctgaagtccccgtcccagaaacaggatggggggacagcccctgtggcatcagcctctcccaaactctgtttggcctggcagggcatgcttctactgaagaacagcaactttccttccaacatgcatctgttgcagggtgacctccaagtggctagtagtcttcttgtggagggttcaactggaggcaaagtggcccagctcaagatcactcagcgtctccgtttggaccagcccaagttggatgaagtaactcgacgcatcaaagtagcagggcccaatggttatgccattcttttggctgtgcctggaagttctgacagccggtcctcctcttcctcagctgcatcagacactgccacttctactcagaggccacttaggaaccttgtgtcctatttaaagcaaaagcaggcagccggggtgatcagcctccctgtggggggcaacaaagacaaggaaaacaccggggtccttcatgccttcccaccttgtgagttctcccagcagttcctggattcccctgccaaggcactggccaaatctgaagaagattacctggtcatgatcattgtccgtgggtttggttttcagataggagttaggtatgagaacaagaagagagaaaacttggcgctgaccctgttatagtggttatagtggtgtccctaaagggaggaaatgatttcagcaaaactggttgaacagcggatgaagatatggaattcaaagctctaatggacctttttgaagagaagttgtggcttatgtggagtttacatgggcctctgatggaagaaagctaatctgtttagtatttgtgcattttactaaaatggcagcttaaagttgtgtatctgctattgtgatgccaatgccggtgttttaagtggaaaaaaaatgacctctttgatttgtgctgtgtacacaagatttctggaaaagtaaagaaaaaccctttttatggctcacacagcttaagagtagctgtctctcaaacgtgcgctcacagttgagctgcttttgttttattctaaataaattgtttcttttgagga

SEQ ID NO: 286141 - DNA, 3363 bp, Homo sapiens
ggcgccttcctggagcgcggggagatgtaaagatagacaaataattttcccaatgagactgtagaagagagagcaattggccaatgaggactgcggggcgggaccctgtgccgcggcggagtccaagatggcggcgtgcggttccgctgtgtgaaacgagcgcggggcggcgggttactcagctccgcggagacgacctccgacgacccgcaacaatgaagggaaaagagcgctcgccagtgaaggccaaacgctcccgtggtggtgaggactcgacttcccgcggtgagcggagcaagaagttagggggctctggtggcagcaatgggagcagcagcggaaagaccgatagcggcggtgggtcgcggcggagtctcctcctggacaagtccagcagtcgaggtggcagccgcgagtatgataccggtgggggcagctccagtagccgcttgcatagttatagctccccgagcaccaaaaattcttcgggcgggggcgagtcgcgcagcagctcccggggtggaggcggggagtcacgttcctctggggccgcctcctcagctcccggcggcggggacggcgcggaatacaagactctgaagataagcgagttggggtcccagcttagtgacgaagcggtggaggacggcctgtttcatgagttcaaacgcttcggtgatgtaagtgtgaaaatcagtcatctgtcgggttctggcagcggggatgagcgggtagcctttgtgaacttccggcggccagaggacgcgcgggcggccaagcatgccagaggccgcctggtgctctatgaccggcctctgaagatagaagctgtgtatgtgagccggcgccgcagccgctcccctttagacaaagatacttatcctccatcagccagtgtggtcggggcctctgtaggtggtcaccggcacccccctggaggtggtggaggccagagatcactttcccctggtggcgctgctttgggatacagagactaccggctgcagcagttggctcttggccgcctgccccctccacctccgccaccattgcctcgagacctggagagagaaagagactacccgttctatgagagagtgcgccctgcatacagtcttgagccaagggtgggagctggagcaggtgctgctcctttcagagaagtggatgagatttcacccgaggatgatcagcgagctaaccggacgctcttcttgggcaacctagacatcactgtaacggagagtgatttaagaagggcgtttgatcgctttggagtcatcacagaagtagatatcaagaggccttctcgcggccagactagtacttacggctttctcaaatttgagaacttagatatgtctcaccgggccaaattagcaatgtctggcaaaattataattcggaatcctatcaaaattggttatggtaaagctacacccaccacccgcctctgggtgggaggcctgggaccttgggttcctcttgctgccctggcacgagaatttgatcgatttggcaccatacgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttatgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacggacgaggtagtttggagaagagccagggtgacaagcgagaccgtaaaaactctgcatcagctgaacgagataggaagcaccggacaactgctcccactgagggaaaaagccctctgaaaaaagaagaccgctctgatgggagtgcacctagcaccagcactgcttcctccaagctgaagtccccgtcccagaaacaggatggggggacagcccctgtggcatcagcctctcccaaactctgtttggcctggcagggcatgcttctactgaagaacagcaactttccttccaacatgcatctgttgcagggtgacctccaagtggctagtagtcttcttgtggagggttcaactggaggcaaagtggcccagctcaagatcactcagcgtctccgtttggaccagcccaagttggatgaagtaactcgacgcatcaaagtagcagggcccaatggttatgccattcttttggctgtgcctggaagttctgacagccggtcctcctcttcctcagctgcatcagacactgccacttctactcagaggccacttaggaaccttgtgtcctatttaaagcaaaagcaggcagccggggtgatcagcctccctgtggggggcaacaaagacaaggaaaacaccggggtccttcatgccttcccaccttgtgagttctcccagcagttcctggattcccctgccaaggcactggccaaatctgaagaagattacctggtcatgatcattgtccgtggtgcgtcctaaagtccatgtgtaacttgtatttactactttgacatggttcctgttttgtgatgtgtaatgggatacagcatcagatgcaattttctttttagttgttagttgtagcattttcttttttatatttttataaacgtctttaaaatagaaatcaggacagtttagctatttttttgtttgtttagctattattttaagtgaaagggatgccctaaaggtagcaggcaggcagacagatttgctttaattaggagttcccacccttatgagtaattttttttctctattcagttgttttttttttaatcttgagcttaaaaaatcctcagagttacaaaaccaaaattttgaaaagtcagaatttggagaaaggagtccactgaccatataaagagagtaatagccacct

SEQ ID NO: 286142 - DNA, 1357 bp, Homo sapiens
ccagtgggtattattggtgctttttgaagttgaggtgaaccatccaggaaggtcttgttaatgttatgttcatctataatggcataggggaaatatatatatttttaatattgtaaacatttgtactgaataacctttttttccccccctccgcaagcaaaactggttgaacagcggatgaagatatggaattcaaagctctaatggacctttttgaagagaagttgtggcttatgtggagtttacatgggcctctgatggaagaaagctaatctgtttagtatttgtgcattttactaaaatggcagcttaaagttgtgtatctgctattgtgatgccaatgccggtgttttaagtggaaaaaaaatgacctctttgatttgtgctgtgtacacaagatttctggaaaagtaaagaaaaaccctttttatggctcacacagcttaagagtagctgtctctcaaacgtgcgctcacagttgagctgcttttgttttattctaaataaattgtttcttttgaggaaaatgtttttctgcctggaagtgaattgacggcaaacctttgacccctttgtttgcagccgagggggtgcttgctgctgctcagatcttgtatgtcttgagcaagaagcagggagaccatcaatttcattttgactatcacggtgtgtcaattctgaaggatcactagtgttactgttgaccccctttgtttgcagtgaaggggatcatttgcttctcggttctcaacgtgatgaggaaatggtgctgtttgctggcacgcaagaagccggggcaggcaccctaagcctcaccacagtgcctgagtcgggggcttttgctggtttgaagagctggagttgctgaaatttaagttttgatttattttgttcacccatcacgtttggccttagtttcatttttaatttgaagaaaagtttgaaattgctttatcttgcacttaacatttgcaccaaattgccaaaagaaggagaaatgctccgtttgctttttaaatgttaatgatgatgttaataaagcctttcctgacacatttgaggagctcctccgtctccaggggcttcttaccagagttatgcagtgatgggtttagttctgaatggatgaagagttcctgagagctagcgtttgtaattagaaccgttacttggtatctgtgccttatttgacctttggttccacatgccttggatgtgcatgcaccgtgacggtttcataggtacgaacgcacactcaggcccagtcacttcggttggtagtacagattgtgaggaaaaagatggaggcatccttaaggaggaaaaatgtttgcctttagttcctgcattatcctgt

SEQ ID NO: 286143 - DNA, 1344 bp, Homo sapiens
aatctctcagtttcagcaaagatcttataaagaattttgttgctttcttaaattcatgaaagaaatgtaagcaattgaggtgtgtaattttcttgcccgtattctctatattaaaaaaaaataagaatatggttctatgaatttcttgtgctatttttgctttccttgaattattaaaatatgttgcatagaactaatattgttttcttttttatttttatacaggaaggagagaaatattgttcatgtaatgtgttacctttttttgtctgtgtgatctacaagagcatggctgaaatgttaccatttttaactagtgttttgactgaagattattatgaaaagttttacttttgttagattcctaattaaaaatgcctatactcttttataggagtttcaacttttgcaatttggtaataacagatttaggtaagtaaaaaatgagaatctcatacagttctgaagatctaagtttggttgagaatttaatgtttcatcaccagtaaattcaattaaagacttttgattcaattaaagactcagttctgcctacacctgcaagaactgagttgatctgtacatcaacatttctgatgtttctttggtagttgctgctggagtcagaagttaggaacaaatctaatggcctttgtaatgtcctctgtcatttcacggaggaatgacttagaggaacaaagctttcctgtgatttctttcttcaacagatggctaatggcacagcattgcagttagaatcttgtttaagatactaggagcacgtcctggactaaaaatttctacataagctttagcaacaaccttatagcttcctttgacttttttgtagagcttacagaatgtatggctgcctaagtaatagtctctgaattaatgggtaaaaaatatattatgagttttttatcctcacgtatggtgctaggctatactggatttgggctaacaaaagcttgttaacttttttttgtctcattgacagaagtattttatatctcatattttacattacataggtgtgtgtgtgtgtatgaaataaaagtttgaaaataaagtgatatactcttttttaatctgctctgtggtagtctatctttttccataaaaacaatgagatcatgacccaacaaatttatttcagaactcacatatatacctgtagctttttcttttcaggtaatggtcttcagaaatttgacttgtcttctcggagtattgaactatttaaacattttattttaagaagtatacaaagacacataggacattaaacatgttatagttttgttgcttgtctttttcatttgagtaagatattctatgccc

SEQ ID NO: 286144 - DNA, 1281 bp, Homo sapiens
aggggaatccaggaactgctgggagaactcacaaggtgggaaggcatgaaggagattacctggtcatgatcattgtccgtgcaaaactggttgaacagcggatgaagatatggaattcaaagctctaatggacctttttgaagagaagttgtggcttatgtggagtttacatgggcctctgatggaagaaagctaatctgtttagtatttgtgcattttactaaaatggcagcttaaagttgtgtatctgctattgtgatgccaatgccggtgttttaagtggaaaaaaaatgacctctttgatttgtgctgtgtacacaagatttctggaaaagtaaagaaaaaccctttttatggctcacacagcttaagagtagctgtctctcaaacgtgcgctcacagttgagctgcttttgttttattctaaataaattgtttcttttgaggaaaatgtttttctgcctggaagtgaattgacggcaaacctttgacccctttgtttgcagccgagggggtgcttgctgctgctcagatcttgtatgtcttgagcaagaagcagggagaccatcaatttcattttgactatcacggtgtgtcaattctgaaggatcactagtgttactgttgaccccctttgtttgcagtgaaggggatcatttgcttctcggttctcaacgtgatgaggaaatggtgctgtttgctggcacgcaagaagccggggcaggcaccctaagcctcaccacagtgcctgagtcgggggcttttgctggtttgaagagctggagttgctgaaatttaagttttgatttattttgttcacccatcacgtttggccttagtttcatttttaatttgaagaaaagtttgaaattgctttatcttgcacttaacatttgcaccaaattgccaaaagaaggagaaatgctccgtttgctttttaaatgttaatgatgatgttaataaagcctttcctgacacatttgaggagctcctccgtctccaggggcttcttaccagagttatgcagtgatgggtttagttctgaatggatgaagagttcctgagagctagcgtttgtaattagaaccgttacttggtatctgtgccttatttgacctttggttccacatgccttggatgtgcatgcaccgtgacggtttcataggtacgaacgcacactcaggcccagtcacttcggttggtagtacagattgtgaggaaaaagatggaggcatccttaaggaggaaaaatgtttgcctttagttcctgcattatcctgt

SEQ ID NO: 286145 - DNA, 524 bp, Homo sapiens
ccagtgggtattattggtgctttttgaagttgaggtgaaccatccaggaaggtcttgttaatgttatgttcatctataatggcataggggaaatatatatatttttaatattgtaaacatttgtactgaataacctttttttccccccctccgcaagcaaaactggttgaacagcggatgaagatatggaattcaaagctctaatggacctttttgaagagaagttgtggcttatgtggagtttacatgggcctctgatggaagaaagctaatctgtttagtatttgtgcattttactaaaatggcagcttaaagttgtgtatctgctattgtgatgccaatgccggtgttttaagtggaaaaaaaatgacctctttgatttgtgctgtgtacacaagatttctggaaaagtaaagaaaaaccctttttatggctcacacagcttaagagtagctgtctctcaaacgtgcgctcacagttgagctgcttttgttttattctaaataaattgtttcttttgagga

SEQ ID NO: 286146 - DNA, 1962 bp, Homo sapiens
ggcgccttcctggagcgcggggagatgtaaagatagacaaataattttcccaatgagactgtagaagagagagcaattggccaatgaggactgcggggcgggaccctgtgccgcggcggagtccaagatggcggcgtgcggttccgctgtgtgaaacgagcgcggggcggcgggttactcagctccgcggagacgacctccgacgacccgcaacaatgaagggaaaagagcgctcgccagtgaaggccaaacgctcccgtggtggtgaggactcgacttcccgcggtgagcggagcaagaagttagggggctctggtggcagcaatgggagcagcagcggaaagaccgatagcggcggtgggtcgcggcggagtctcctcctggacaagtccagcagtcgaggtggcagccgcgagtatgataccggtgggggcagctccagtagccgcttgcatagttatagctccccgagcaccaaaaattcttcgggcgggggcgagtcgcgcagcagctcccggggtggaggcggggagtcacgttcctctggggccgcctcctcagctcccggcggcggggacggcgcggaatacaagactctgaagataagcgagttggggtcccagcttagtgacgaagcggtggaggacggcctgtttcatgagttcaaacgcttcggtgatgtaagtgtgaaaatcagtcatctgtcgggttctggcagcggggatgagcgggtagcctttgtgaacttccggcggccagaggacgcgcgggcggccaagcatgccagaggccgcctggtgctctatgaccggcctctgaagatagaagctgtgtatgtgagccggcgccgcagccgctcccctttagacaaagatacttatcctccatcagccagtgtggtcggggcctctgtaggtggtcaccggcacccccctggaggtggtggaggccagagatcactttcccctggtggcgctgctttgggatacagagactaccggctgcagcagttggctcttggccgcctgccccctccacctccgccaccattgcctcgagacctggagagagaaagagactacccgttctatgagagagtgcgccctgcatacagtcttgagccaagggtgggagctggagcaggtgctgctcctttcagagaagtggatgagatttcacccgaggatgatcagcgagctaaccggacgctcttcttgggcaacctagacatcactgtaacggagagtgatttaagaagggcgtttgatcgctttggagtcatcacagaagtagatatcaagaggccttctcgcggccagactagtacttacggctttctcaaatttgagaacttagatatgtctcaccgggccaaattagcaatgtctggcaaaattataattcggaatcctatcaaaattggttatggtaaacaacaaccttatagcttcctttgacttttttgtagagcttacagaatgtatggctgcctaagtaatagtctctgaattaatgggtaaaaaatatattatgagttttttatcctcacgtatggtgctaggctatactggatttgggctaacaaaagcttgttaacttttttttgtctcattgacagaagtattttatatctcatattttacattacataggtgtgtgtgtgtgtatgaaataaaagtttgaaaataaagtgatatactcttttttaatctgctctgtggtagtctatctttttccataaaaacaatgagatcatgacccaacaaatttatttcagaactcacatatatacctgtagctttttcttttcaggtaatggtcttcagaaatttgacttgtcttctcggagtattgaactatttaaacattttattttaagaagtatacaaagacacataggacattaaacatgttatagttttgttgcttgtctttttcatttgagtaagatattctatgccc

SEQ ID NO: 286147 - DNA, 1392 bp, Homo sapiens
  misc_feature (794)..(794): n is a, c, g, or t
  misc_feature (802)..(802): n is a, c, g, or t
  misc_feature (804)..(804): n is a, c, g, or t
  misc_feature (837)..(838): n is a, c, g, or t
aatctctcagtttcagcaaagatcttataaagaattttgttgctttcttaaattcatgaaagaaatgtaagcaattgaggtgtgtaattttcttgcccgtattctctatattaaaaaaaaataagaatatggttctatgaatttcttgtgctatttttgctttccttgaattattaaaatatgttgcatagaactaatattgttttcttttttatttttatacaggaaggagagaaatattgttcatgtaatgtgttacctttttttgtctgtgtgatctacaagagcatggctgaaatgttaccatttttaactagtgttttgactgaagattattatgaaaagttttacttttgttagattcctaattaaaaatgcctatactcttttataggagtttcaacttttgcaatttggtaataacagatttaggtaagtaaaaaatgagaatctcatacagttctgaagatctaagtttggttgagaatttaatgtttcatcaccagtaaattcaattaaagacttttgattcaattaaagactcagttctgcctacacctgcaagaactgagttgatctgtacatcaacatttctgatgtttctttggtagttgctgctggagtcagaagttaggaacaaatctaatggcctttgtaatgtcctctgtcatttcacggaggaatgacttagaggaacaaagctttcctgtgatttctttcttcaacagatggctaatggcacagcattgcagttagaatcttttggggtttttcttcttttaacaagaaaaatnaccttaangnggaggggcgccaaacccggtgggttccctggannctaaaaatttctacataagctttagcaacaaccttatagcttcctttgacttttttgtagagcttacagaatgtatggctgcctaagtaatagtctctgaattaatgggtaaaaaatatattatgagttttttatcctcacgtatggtgctaggctatactggatttgggctaacaaaagcttgttaacttttttttgtctcattgacagaagtattttatatctcatattttacattacataggtgtgtgtgtgtgtatgaaataaaagtttgaaaataaagtgatatactcttttttaatctgctctgtggtagtctatctttttccataaaaacaatgagatcatgacccaacaaatttatttcagaactcacatatatacctgtagctttttcttttcaggtaatggtcttcagaaatttgacttgtcttctcggagtattgaactatttaaacattttattttaagaagtatacaaagacacataggacattaaacatgttatagttttgttgcttgtctttttcatttgagtaagatattctatgccc

SEQ ID NO: 286148 - DNA, 4146 bp, Homo sapiens
ggcgccttcctggagcgcggggagatgtaaagatagacaaataattttcccaatgagactgtagaagagagagcaattggccaatgaggactgcggggcgggaccctgtgccgcggcggagtccaagatggcggcgtgcggttccgctgtgtgaaacgagcgcggggcggcgggttactcagctccgcggagacgacctccgacgacccgcaacaatgaagggaaaagagcgctcgccagtgaaggccaaacgctcccgtggtggtgaggactcgacttcccgcggtgagcggagcaagaagttagggggctctggtggcagcaatgggagcagcagcggaaagaccgatagcggcggtgggtcgcggcggagtctcctcctggacaagtccagcagtcgaggtggcagccgcgagtatgataccggtgggggcagctccagtagccgcttgcatagttatagctccccgagcaccaaaaattcttcgggcgggggcgagtcgcgcagcagctcccggggtggaggcggggagtcacgttcctctggggccgcctcctcagctcccggcggcggggacggcgcggaatacaagactctgaagataagcgagttggggtcccagcttagtgacgaagcggtggaggacggcctgtttcatgagttcaaacgcttcggtgatgtaagtgtgaaaatcagtcatctgtcgggttctggcagcggggatgagcgggtagcctttgtgaacttccggcggccagaggacgcgcgggcggccaagcatgccagaggccgcctggtgctctatgaccggcctctgaagatagaagctgtgtatgtgagccggcgccgcagccgctcccctttagacaaagatacttatcctccatcagccagtgtggtcggggcctctgtaggtggtcaccggcacccccctggaggtggtggaggccagagatcactttcccctggtggcgctgctttgggatacagagactaccggctgcagcagttggctcttggccgcctgccccctccacctccgccaccattgcctcgagacctggagagagaaagagactacccgttctatgagagagtgcgccctgcatacagtcttgagccaagggtgggagctggagcaggtgctgctcctttcagagaagtggatgagatttcacccgaggatgatcagcgagctaaccggacgctcttcttgggcaacctagacatcactgtaacggagagtgatttaagaagggcgtttgatcgctttggagtcatcacagaagtagatatcaagaggccttctcgcggccagactagtacttacggctttctcaaatttgagaacttagatatgtctcaccgggccaaattagcaatgtctggcaaaattataattcggaatcctatcaaaattggttatggtaaagctacacccaccacccgcctctgggtgggaggcctgggaccttgggttcctcttgctgccctggcacgagaatttgatcgatttggcaccatacgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttatgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacggacgaggtagtttggagaagagccagggtgacaagcgagaccgtaaaaactctgcatcagctgaacgagataggaagcaccggacaactgctcccactgagggaaaaagccctctgaaaaaagaagaccgctctgatgggagtgcacctagcaccagcactgcttcctccaagctgaagtccccgtcccagaaacaggatggggggacagcccctgtggcatcagcctctcccaaactctgtttggcctggcagggcatgcttctactgaagaacagcaactttccttccaacatgcatctgttgcagggtgacctccaagtggctagtagtcttcttgtggagggttcaactggaggcaaagtggcccagctcaagatcactcagcgtctccgtttggaccagcccaagttggatgaagtaactcgacgcatcaaagtagcagggcccaatggttatgccattcttttggctgtgcctggaagttctgacagccggtcctcctcttcctcagctgcatcagacactgccacttctactcagaggccacttaggaaccttgtgtcctatttaaagcaaaagcaggcagccggggtgatcagcctccctgtggggggcaacaaagacaaggaaaacaccggggtccttcatgccttcccaccttgtgagttctcccagcagttcctggattcccctgccaaggcactggccaaatctgaagaagattacctggtcatgatcattgtccgtgcaaaactggttgaacagcggatgaagatatggaattcaaagctctaatggacctttttgaagagaagttgtggcttatgtggagtttacatgggcctctgatggaagaaagctaatctgtttagtatttgtgcattttactaaaatggcagcttaaagttgtgtatctgctattgtgatgccaatgccggtgttttaagtggaaaaaaaatgacctctttgatttgtgctgtgtacacaagatttctggaaaagtaaagaaaaaccctttttatggctcacacagcttaagagtagctgtctctcaaacgtgcgctcacagttgagctgcttttgttttattctaaataaattgtttcttttgaggaaaatgtttttctgcctggaagtgaattgacggcaaacctttgacccctttgtttgcagccgagggggtgcttgctgctgctcagatcttgtatgtcttgagcaagaagcagggagaccatcaatttcattttgactatcacggtgtgtcaattctgaaggatcactagtgttactgttgaccccctttgtttgcagtgaaggggatcatttgcttctcggttctcaacgtgatgaggaaatggtgctgtttgctggcacgcaagaagccggggcaggcaccctaagcctcaccacagtgcctgagtcgggggcttttgctggtttgaagagctggagttgctgaaatttaagttttgatttattttgttcacccatcacgtttggccttagtttcatttttaatttgaagaaaagtttgaaattgctttatcttgcacttaacatttgcaccaaattgccaaaagaaggagaaatgctccgtttgctttttaaatgttaatgatgatgttaataaagcctttcctgacacatttgaggagctcctccgtctccaggggcttcttaccagagttatgcagtgatgggtttagttctgaatggatgaagagttcctgagagctagcgtttgtaattagaaccgttacttggtatctgtgccttatttgacctttggttccacatgccttggatgtgcatgcaccgtgacggtttcataggtacgaacgcacactcaggcccagtcacttcggttggtagtacagattgtgaggaaaaagatggaggcatccttaaggaggaaaaatgtttgcctttagttcctgcattatcctgt

SEQ ID NO: 286149 - DNA, 4257 bp, Homo sapiens
ggcgccttcctggagcgcggggagatgtaaagatagacaaataattttcccaatgagactgtagaagagagagcaattggccaatgaggactgcggggcgggaccctgtgccgcggcggagtccaagatggcggcgtgcggttccgctgtgtgaaacgagcgcggggcggcgggttactcagctccgcggagacgacctccgacgacccgcaacaatgaagggaaaagagcgctcgccagtgaaggccaaacgctcccgtggtggtgaggactcgacttcccgcggtgagcggagcaagaagttagggggctctggtggcagcaatgggagcagcagcggaaagaccgatagcggcggtgggtcgcggcggagtctcctcctggacaagtccagcagtcgaggtggcagccgcgagtatgataccggtgggggcagctccagtagccgcttgcatagttatagctccccgagcaccaaaaattcttcgggcgggggcgagtcgcgcagcagctcccggggtggaggcggggagtcacgttcctctggggccgcctcctcagctcccggcggcggggacggcgcggaatacaagactctgaagataagcgagttggggtcccagcttagtgacgaagcggtggaggacggcctgtttcatgagttcaaacgcttcggtgatgtaagtgtgaaaatcagtcatctgtcgggttctggcagcggggatgagcgggtagcctttgtgaacttccggcggccagaggacgcgcgggcggccaagcatgccagaggccgcctggtgctctatgaccggcctctgaagatagaagctgtgtatgtgagccggcgccgcagccgctcccctttagacaaagatacttatcctccatcagccagtgtggtcggggcctctgtaggtggtcaccggcacccccctggaggtggtggaggccagagatcactttcccctggtggcgctgctttgggatacagagactaccggctgcagcagttggctcttggccgcctgccccctccacctccgccaccattgcctcgagacctggagagagaaagagactacccgttctatgagagagtgcgccctgcatacagtcttgagccaagggtgggagctggagcaggtgctgctcctttcagagaagtggatgagatttcacccgaggatgatcagcgagctaaccggacgctcttcttgggcaacctagacatcactgtaacggagagtgatttaagaagggcgtttgatcgctttggagtcatcacagaagtagatatcaagaggccttctcgcggccagactagtacttacggctttctcaaatttgagaacttagatatgtctcaccgggccaaattagcaatgtctggcaaaattataattcggaatcctatcaaaattggttatggtaaagctacacccaccacccgcctctgggtgggaggcctgggaccttgggttcctcttgctgccctggcacgagaatttgatcgatttggcaccatacgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttatgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacggacgaggtagtttggagaagagccagggtgacaagcgagaccgtaaaaactctgcatcagctgaacgagataggaagcaccggacaactgctcccactgagggaaaaagccctctgaaaaaagaagaccgctctgatgggagtgcacctagcaccagcactgcttcctccaagctgaagtccccgtcccagaaacaggatggggggacagcccctgtggcatcagcctctcccaaactctgtttggcctggcagggcatgcttctactgaagaacagcaactttccttccaacatgcatctgttgcagggtgacctccaagtggctagtagtcttcttgtggagggttcaactggaggcaaagtggcccagctcaagatcactcagcgtctccgtttggaccagcccaagttggatgaagtaactcgacgcatcaaagtagcagggcccaatggttatgccattcttttggctgtgcctggaagttctgacagccggtcctcctcttcctcagctgcatcagacactgccacttctactcagaggccacttaggaaccttgtgtcctatttaaagcaaaagcaggcagccggggtgatcagcctccctgtggggggcaacaaagacaaggaaaacaccggggtccttcatgccttcccaccttgtgagttctcccagcagttcctggattcccctgccaaggcactggccaaatctgaagaagattacctggtcatgatcattgtccgtgggtttggttttcagataggagttaggtatgagaacaagaagagagaaaacttggcgctgaccctgttatagtggttatagtggtgtccctaaagggaggaaatgatttcagcaaaactggttgaacagcggatgaagatatggaattcaaagctctaatggacctttttgaagagaagttgtggcttatgtggagtttacatgggcctctgatggaagaaagctaatctgtttagtatttgtgcattttactaaaatggcagcttaaagttgtgtatctgctattgtgatgccaatgccggtgttttaagtggaaaaaaaatgacctctttgatttgtgctgtgtacacaagatttctggaaaagtaaagaaaaaccctttttatggctcacacagcttaagagtagctgtctctcaaacgtgcgctcacagttgagctgcttttgttttattctaaataaattgtttcttttgaggaaaatgtttttctgcctggaagtgaattgacggcaaacctttgacccctttgtttgcagccgagggggtgcttgctgctgctcagatcttgtatgtcttgagcaagaagcagggagaccatcaatttcattttgactatcacggtgtgtcaattctgaaggatcactagtgttactgttgaccccctttgtttgcagtgaaggggatcatttgcttctcggttctcaacgtgatgaggaaatggtgctgtttgctggcacgcaagaagccggggcaggcaccctaagcctcaccacagtgcctgagtcgggggcttttgctggtttgaagagctggagttgctgaaatttaagttttgatttattttgttcacccatcacgtttggccttagtttcatttttaatttgaagaaaagtttgaaattgctttatcttgcacttaacatttgcaccaaattgccaaaagaaggagaaatgctccgtttgctttttaaatgttaatgatgatgttaataaagcctttcctgacacatttgaggagctcctccgtctccaggggcttcttaccagagttatgcagtgatgggtttagttctgaatggatgaagagttcctgagagctagcgtttgtaattagaaccgttacttggtatctgtgccttatttgacctttggttccacatgccttggatgtgcatgcaccgtgacggtttcataggtacgaacgcacactcaggcccagtcacttcggttggtagtacagattgtgaggaaaaagatggaggcatccttaaggaggaaaaatgtttgcctttagttcctgcattatcctgt

SEQ ID NO: 286150 - DNA, 3293 bp, Homo sapiens
ggcgccttcctggagcgcggggagatgtaaagatagacaaataattttcccaatgagactgtagaagagagagcaattggccaatgaggactgcggggcgggaccctgtgccgcggcggagtccaagatggcggcgtgcggttccgctgtgtgaaacgagcgcggggcggcgggttactcagctccgcggagacgacctccgacgacccgcaacaatgaagggaaaagagcgctcgccagtgaaggccaaacgctcccgtggtggtgaggactcgacttcccgcggtgagcggagcaagaagttagggggctctggtggcagcaatgggagcagcagcggaaagaccgatagcggcggtgggtcgcggcggagtctcctcctggacaagtccagcagtcgaggtggcagccgcgagtatgataccggtgggggcagctccagtagccgcttgcatagttatagctccccgagcaccaaaaattcttcgggcgggggcgagtcgcgcagcagctcccggggtggaggcggggagtcacgttcctctggggccgcctcctcagctcccggcggcggggacggcgcggaatacaagactctgaagataagcgagttggggtcccagcttagtgacgaagcggtggaggacggcctgtttcatgagttcaaacgcttcggtgatgtaagtgtgaaaatcagtcatctgtcgggttctggcagcggggatgagcgggtagcctttgtgaacttccggcggccagaggacgcgcgggcggccaagcatgccagaggccgcctggtgctctatgaccggcctctgaagatagaagctgtgtatgtgagccggcgccgcagccgctcccctttagacaaagatacttatcctccatcagccagtgtggtcggggcctctgtaggtggtcaccggcacccccctggaggtggtggaggccagagatcactttcccctggtggcgctgctttgggatacagagactaccggctgcagcagttggctcttggccgcctgccccctccacctccgccaccattgcctcgagacctggagagagaaagagactacccgttctatgagagagtgcgccctgcatacagtcttgagccaagggtgggagctggagcaggtgctgctcctttcagagaagtggatgagatttcacccgaggatgatcagcgagctaaccggacgctcttcttgggcaacctagacatcactgtaacggagagtgatttaagaagggcgtttgatcgctttggagtcatcacagaagtagatatcaagaggccttctcgcggccagactagtacttacggctttctcaaatttgagaacttagatatgtctcaccgggccaaattagcaatgtctggcaaaattataattcggaatcctatcaaaattggttatggtaaagctacacccaccacccgcctctgggtgggaggcctgggaccttgggttcctcttgctgccctggcacgagaatttgatcgatttggcaccatacgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttatgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacggacgaggtagtttggagaagagccagggtgacaagcgagaccgtaaaaactctgcatcagctgaacgagataggaagcaccggacaactgctcccactgagggaaaaagccctctgaaaaaagaagaccgctctgatgggagtgcacctagcaccagcactgcttcctccaagctgaagtccccgtcccagaaacaggatggggggacagcccctgtggcatcagcctctcccaaactctgtttggcctggcagggcatgcttctactgaagaacagcaactttccttccaacatgcatctgttgcagggtgacctccaagtggctagtagtcttcttgtggagggttcaactggaggcaaagtggcccagctcaagatcactcagcgtctccgtttggaccagcccaagttggatgaagtaactcgacgcatcaaagtagcagggcccaatggttatgccattcttttggctgtgcctggaagttctgacagccggtcctcctcttcctcagctgcatcagacactgccacttctactcagaggccacttaggaaccttgtgtcctatttaaagcaaaagcaggcagccggggtgatcagcctccctgtggggggcaacaaagacaaggaaaacaccggggtccttcatgccttcccaccttgtgagttctcccagcagttcctggattcccctgccaaggcactggccaaatctgaagaagattacctggtcatgatcattgtccgtgggtttggttttcagataggagttaggtatgagaacaagaagagagaaaacttggcgctgaccctgttatagtggttatagtggtgtccctaaagggaggaaatgatttcaggtaaccacagtgaaatgttaagctgaatgaagagttttatatgtatggtttaaacagagttgaaaagtgagattcctgaagtgttctttggctgtttaacaattatttgtatgagtgttttattaaaataacggctgctgtctttggtaacatagatgagggtggatttttaaatggctttgtatcgacccctttctacaataatggagtagtctatgttgctccatataaattac

SEQ ID NO: 286151 - DNA, 846 bp, Homo sapiens
gtgtcttaaatcttagctgttttgcataatgcatgatcctctctctctctctctgtctctttctctctctctctctccctctgtttttcagaggtgagggtcctgctgtgttacccaggccggagtgcagtgactacttacaggcacgatcatagtgcactagagccttgaactcccgggctccagtattactcctgcctcagcctcctgagtatctgggactataggagtgcaccaccattcctggcataatcctctttttatgttgagttgaagaaagtcacaagacgtgagacgctttatgttgcagttaatggtctcttcctcccttttctctgttcctgcaaatggacaattattccttctcacaaggtttttggcttcccacttcagcatgcctccagcagtgttctaaaattactctacaattgccaaagtaagagcagcagatgctctaaatctatttccaggacacccgtctcatgatcaaggtataaattctgcagtgatcaaaattcataaaggaaaatgaggctcctgcgtgtgtgtattagaagataattatgcaggcatgtagaagttgtattccagtttttattaacaaattcattacattatttaatgatttaaaaaaatctccctaagactaaaattaagaaaatcttagtaatgaagtatcattagaaaattaacttgttattgtggatttgaaatctctagctcctcatcgttattttaaaattctattgaaggatcattttgaagcacttatgaaaaacaaaaaaatttagaacataattttttgttatgcaaggtaattgcagctacaatttggattctaagaga

SEQ ID NO: 286152 - DNA, 692 bp, Homo sapiens
gtgtcttaaatcttagctgttttgcataatgcatgatcctctctctctctctctgtctctttctctctctctctctccctctgtttttcagaggtgagggtcctgctgtgttacccaggccggagtgcagtgactacttacaggcacgatcatagtgcactagagccttgaactcccgggctccagtattactcctgcctcagcctcctgagtatctgggactataggagtgcaccaccattcctggcataatcctctttttatgttgagttgaagaaagtcacaagacgtgagacgctttatgttgcagttaatggtctcttcctcccttttctctgttcctgcaaatggacaattattccttctcacaaggtttttggcttcccacttcagcatgcctccagcagtgttctaaaattactctacaattgccaaagtaagagcagcagatgctctaaatctatttccaggacacccgtctcatgatcaagaaatggggtccaaactccttggctgccagatgagcaagtaagtactggagtaaagatgctgcgcaaaaggcaaaatgatgtcaaagcagtgtaaactgatacagatcaaagaacaggagtggaaaattgcaagcagggatatgtagcggctctgtatggcccaatgtgctcaaaactctccagaggttgttaatttcctgg

SEQ ID NO: 286153 - DNA, 757 bp, Homo sapiens
gtgtcttaaatcttagctgttttgcataatgcatgatcctctctctctctctctgtctctttctctctctctctctccctctgtttttcagaggtgagggtcctgctgtgttacccaggccggagtgcagtgactacttacaggcacgatcatagtgcactagagccttgaactcccgggctccagtattactcctgcctcagcctcctgagtatctgggactataggagtgcaccaccattcctggcataatcctctttttatgttgagttgaagaaagtcacaagacgtgagacgctttatgttgcagttaatggtctcttcctcccttttctctgttcctgcaaatggacaattattccttctcacaaggtttttggcttcccacttcagcatgcctccagcagtgttctaaaattactctacaattgccaaagtaagagcagcagatgctctaaatctatttccaggacacccgtctcatgatcaagaacaactgctgctgacaagtacccaagagcatatctgtgcctcagtttcctaatttgtaaacggagataacaatagtacttccattttggagttgctgtgaggaaaaaactggagtaaagatgctgcgcaaaaggcaaaatgatgtcaaagcagtgtaaactgatacagatcaaagaacaggagtggaaaattgcaagcagggatatgtagcggctctgtatggcccaatgtgctcaaaactctccagaggttgttaatttcctgg

SEQ ID NO: 286154 - DNA, 917 bp, Homo sapiens
  misc_feature (643)..(643): n is a, c, g, or t
  misc_feature (648)..(648): n is a, c, g, or t
  misc_feature (654)..(654): n is a, c, g, or t
  misc_feature (685)..(685): n is a, c, g, or t
ggcctcgcctccggggctcgggatgagtcgcgggccccagctgagcggctccggctccaggcgcctgtcgctgcttctgccgtcgccaccgaagagcggccgccgcccctgagggaaggagggagggaagcagccgctgacccgtggcatgagctggatgcggtgtccgttgcaggactagggcgccgacatgaacctgcaccaggtgctgaccggggctgtgaaccctggcgaccactgcttctccgtgggcagcattggcgaccagcgcttcacggcttatgcatctggatgtgacattgtaatactgggaagcgattttgaaagattacagataatcccaggagctaaacatggaaatattcaagtgggatgtgtagactgttcaatgcaacaaggcaagattgcagcgtcttatggaaatgttatctccatttttgaaccagttaacctaccaaaacaaaagaaaaatttggaattatatagtcagtggcagaaaagtggccaattttttctggaatcaatagcacacaatataacctgggatcccacaggcagtcgtcttttaactggttccagctatttgcaactctggtccaatactaacttggagaagccaactgaagatgaaaatttaaataanacagntcttanctttggagattggaaatgcatttggcattgnaaaactgcttcccaagttcatttaatgaaattttcaccagatggagaattttttgccactgctgggaaggatgactgtcttttgacggttcggtataatgtagaaaactggcggacagctgttacttctccagatggaagttcagaaaaacaatcccaaggagacattgacttttcttttgtgtatctggcccatcctcgagcagtaaatggattttcctggcgtaaaacaa

SEQ ID NO: 286155 - DNA, 795 bp, Homo sapiens
  misc_feature (521)..(521): n is a, c, g, or t
  misc_feature (526)..(526): n is a, c, g, or t
  misc_feature (532)..(532): n is a, c, g, or t
  misc_feature (563)..(563): n is a, c, g, or t
gcggctgcccgaggtccagaggaagtgtgtggacagcgcggccttcctggccggactagggcgccgacatgaacctgcaccaggtgctgaccggggctgtgaaccctggcgaccactgcttctccgtgggcagcattggcgaccagcgcttcacggcttatgcatctggatgtgacattgtaatactgggaagcgattttgaaagattacagataatcccaggagctaaacatggaaatattcaagtgggatgtgtagactgttcaatgcaacaaggcaagattgcagcgtcttatggaaatgttatctccatttttgaaccagttaacctaccaaaacaaaagaaaaatttggaattatatagtcagtggcagaaaagtggccaattttttctggaatcaatagcacacaatataacctgggatcccacaggcagtcgtcttttaactggttccagctatttgcaactctggtccaatactaacttggagaagccaactgaagatgaaaatttaaataanacagntcttanctttggagattggaaatgcatttggcattgnaaaactgcttcccaagttcatttaatgaaattttcaccagatggagaattttttgccactgctgggaaggatgactgtcttttgacggttcggtataatgtagaaaactggcggacagctgttacttctccagatggaagttcagaaaaacaatcccaaggagacattgacttttcttttgtgtatctggcccatcctcgagcagtaaatggattttcctggcgtaaaacaa

SEQ ID NO: 286156 - DNA, 332 bp, Homo sapiens
gggagggaagcagccgctgacccgtggcatgagctggatgcggtgtccgttgcaggactagggcgccgacatgaacctgcaccaggtgctgaccggggctgtgaaccctggcgaccactgcttctccgtgggcagcattggcgaccagcgcttcacggtgagtgagggaggccctcgcgtcgcccgtggcccggcctttgcccgtcattctgggccgagcttggcccagaacgacgggcagaggcgcgaggtcttgtctccccaggggggtccttaccacccagaacccagcagacctggcccttgagaactaaggaagcaaaaccatgtcg

SEQ ID NO: 286157 - DNA, 232 bp, Homo sapiens
tggaaggtaagggttcatacgttccttactctgtcagccattatcaggtgactgctgtggctggcactgtgctctcagctagagggaagacaagataaattctgctctggaagaacttacattctggttagagagccagacaaatatgtaattatggtaagatgtgtcgggtgttacccagaggtgtaagtgtagatcccagagagcctgggacaggcagctccaggagagc

SEQ ID NO: 286158 - DNA, 413 bp, Homo sapiens
actgaaagttgcatgtgttttaaaggggcataagcttgtggagaacctttctctttggtttagctgcatcgatatgctgattttttaaaatgcactgaacatgcaaaaatgagtatattattgacctcaaatcaatgcccatcactgtttctatcttatacagtgagcttcttggctttttaatattttcattgtgaagttattccaatgaagacaaaattttgtcaaatttattacccagggagctttcaaaatgaagcagagagactttgaccgagcaatttcacttctggaattttattctacttatgcatacttatacatatgtgcaaagacatatatatctgaaagtttattattttttcgaagcattgtttatagggagaaaaagcaggtaacagcccaactgtcct

SEQ ID NO: 286159 - DNA, 1321 bp, Homo sapiens
  misc_feature (3)..(5): n is a, c, g, or t
ggnnnggggccggctgctcaggggaagcccaggctctccgacccagctaccgggaatggggcaccctttggagaagaaccccagcctggggtggggacgcaccggctctccgacagctcaaacacagacagatcttctagagccgagggaatttcttttcgcagaagccattactccccccgccccctaatcgccaccaagccctcctgctgaattctcgcctagcatcctgtcctttcctgtccagcactcacctccatttgtaatgatccatgcctgggagtatttgtttagtgctcacttccgtgacactgtggaagacaggctcagtctccctcactaacctgtgacctgggtcagttttgctccagagggaatccttacggcacagcagtgtacctgtatatagggatggtacgccatgaaggccctcagcaattgctggcaccttgatattggacttctcagcctccagaaacatgagaaatacatttcttttctttataaattacccagtctgtgctattaggttatagcaacacaaaatgaactgagacaagtacccatctattactgtgtctgagcccctgggtgggtttggaacagaggtaagttaaggtacagccgcaaggagctcactgtggaccagggaaggagacccacatctgaaatggatgcctcaatctaatcaccaactgctaggatagagttatacacagcatttggtttataattaaggtgatttttgagagaggagaatattttagtttacaaatctcctctttactaagacacacacacacaaagaaacaacacacacatacacatgttgagaagggcccaaatcatgactggctaggagagcaacagcctctagatggtttttccagattgtgaattaaagatctgctgggttggccaggcatggtggctcacgcctgtaatcctggcacttcaagagtctgaggagggcagatggcttgagcccaggattttgagaccggcctgggcaacatggtgaaaccctgtctctacaaaaaatataaaaattagctgggcgtggtgggtgcgtgcctgtggtcccagctacttgggaggctgaggcaggaagatcacctgagcccagggagatcaaggctgcagtgtgccatcatcacaccactgcactccagcctggatgacagagtgagaccttgtctcaaaagaaaaaaaaaaagatctactgagtctgtcttcagggacaagagcacagtttctcctaggatcttcacacctccctcaaaatgtgtacatttttactgattaaataatttaaaaatct

SEQ ID NO: 286160 - DNA, 475 bp, Homo sapiens
ggaattgtaaactgtgccactttcgcatgaataagattgactttgtcaattgatcactaacatttttcagattagttttaagctagatataattacagacatatcttagtttttgtgcagaatatcgtaatttgcagaagagtttcatgcacttaatctcagttgtataatgtaggcaaggagagctctctggcctctttttaaagatgatgggaccaagggagattgtgacttgcctaaggccacgttattgacatggcttattatagacagaatccagtttttagttcagatcttcctaattcaaaaataagcattcctcccaatggtatacccatcaatgtgtcaaaactgagccaataaaaaggcctaatttattattaggtgacagattgctgtggttccaaatatatgccttaattttatttgaaaaagaaaatgttgggaatagaatatttgtacccaactttgaatt

SEQ ID NO: 286161 - DNA, 1292 bp, Homo sapiens
gccgccggcaggacctggaggcccagatccgaggcctgcgtgaggaggtggagaagggtgagggcagactgcagaccacccacgaggagttgctgctgctgaggcgggagcggcgggagcacagcctggagctggaacgcgcacggtcagaggctggggaggcgctgagtgcgctgcggaggctgcagcggcgcgtctccgagctggaggaggagtcacgcctccaggacgccgacgtgtcggctgcctcgttgcagtcagaactggcccacagcctcgacgacggcgaccagggccagggcgccgacgcacccggagacaccccgaccacccggtccccaaagacccgaaaggcgtccagcccccagccttcacccccggaagagatcttagagccccccaagaagcgaacatccctcagtccagcggagatactggaggagaaggaggtggaagtggccaagctgcaagatgagatctcgctgcagcaggcagagctgcagtccctgcgggaagagctgcagaggcagaaggagctgcgggcgcaggaagaccctggggaggccctgcacagtgccctctcagaccgggacgaggccgtgaacaaggccctggagctgtccctgcagctcaaccgcgtctcgctggagcgagactccctgtctcgggagctgctgcgcgccatccgccagaaggtggcgctcacgcaggagctggaggcctggcaggacgacatgcaggtggtgatcgggcagcagctgcgctcacagcgccagaaggagctgagcgcctccgcgtcgtcgtcgaccccgcgccgtgccgcgccccgcttctcgctgcgcctgggccccgggcccgccggtggctttctcagtaacctcttccgaaggacctgacggctgggcccagagggctgcccttgcccacttaggggctcactttcctcttcaggccaatggagcgacagggcccagattgtcttccaaaagaagctgatgccctccccgccccaggatgctgggcaagggctcatcgggagcaggggctcatccggagcaggggccagctttgtggggcaggagctccaggtgggtggcaggggcaggtgaacagagctattttccgaattaatataggtctatcttttctagggcagggatggggctgggtatttatgtatcaagatcggacagagtaatatataaatcactccaccgatttggcccccattcatagaaagaaagagcatggtaaaaaagcctgaaactttatgtaaaaaaaaaaaaaaaaga

SEQ ID NO: 286162 - DNA, 1427 bp, Homo sapiens
aacaattactgaatgaggaggtagactgggcaggggaggagatggggctcttcgaggtgcggccctgctctataggcgaggaaactgtatatatccgctgagggaggtgcacggcccaaggcgcccagcgatccaggaacgggaacagcctgggccgctggggtgcggggctctccgcggcacccccgtgtggacctgccgcgggatgtcggcgttgcgtgcgtcccgctgaccgcccgcgcttccgtctgcgggaccgtccacagctggaacgcgcacggtcagaggctggggaggcgctgagtgcgctgcggaggctgcagcggcgcgtctccgagctggaggaggagtcacgcctccaggacgccgacgtgtcggctgcctcgttgcagtcagaactggcccacagcctcgacgacggcgaccagggccagggcgccgacgcacccggagacaccccgaccacccggtccccaaagacccgaaaggcgtccagcccccagccttcacccccggaagagatcttagagccccccaagaagcgaacatccctcagtccagcggagatactggaggagaaggaggtggaagtggccaagctgcaagatgagatctcgctgcagcaggcagagctgcagtccctgcgggaagagctgcagaggcagaaggagctgcgggcgcaggaagaccctggggaggccctgcacagtgccctctcagaccgggacgaggccgtgaacaaggccctggagctgtccctgcagctcaaccgcgtctcgctggagcgagactccctgtctcgggagctgctgcgcgccatccgccagaaggtggcgctcacgcaggagctggaggcctggcaggacgacatgcaggtggtgatcgggcagcagctgcgctcacagcgccagaaggagctgagcgcctccgcgtcgtcgtcgaccccgcgccgtgccgcgccccgcttctcgctgcgcctgggccccgggcccgccggtggctttctcagtaacctcttccgaaggacctgacggctgggcccagagggctgcccttgcccacttaggggctcactttcctcttcaggccaatggagcgacagggcccagattgtcttccaaaagaagctgatgccctccccgccccaggatgctgggcaagggctcatcgggagcaggggctcatccggagcaggggccagctttgtggggcaggagctccaggtgggtggcaggggcaggtgaacagagctattttccgaattaatataggtctatcttttctagggcagggatggggctgggtatttatgtatcaagatcggacagagtaatatataaatcactccaccgatttggcccccattcatagaaagaaagagcatggtaaaaaagcctgaaactttatgtaaaaaaaaaaaaaaaaga

SEQ ID NO: 286163 - DNA, 587 bp, Homo sapiens
atgctctaaatcctcgtgtaggacgcccaacatctggacgcacacagcatgactactagtgctgagcagccacccacagagggcatatgcacaaagacattaaatgtaaaagaaatggcctgtgctgagcaacagagaaagctgtatcagagataaaaccaaacagtaagcttcctatgacacagctccagtggaagaagagaaagcaccacctcattactgcaaggtggaaacagaagtccaagagagattctttgttaccacttgacatggatgggaatctaggcactccctgatggagagaagaaggactgcctcattatgctcaccatgtaacctacaatagcaccatggaagggggatgtggacgtctgttatcactgggtggttgtgaaagccctgactctattggcttctttggacataatgccagtggggagggggaagaatgcctcattaatgccatctgtgggtagaaatccaggctacccactttgctttttgatagtgtggtgggggatggggccacatatttttttctgcgatatttagcagaaatacaaagcagttattgccaacaaaaactg

SEQ ID NO: 286164 - DNA, 468 bp, Homo sapiens
ctgccaaaccctctggccctaacctatcatgtatgaaaggtgaaataggagcatactctgatttcacagttttaaccatcatcctgtgaccccaaaagtccatcacaggagggcatatgcacaaagacattaaatgtaaaagaaatggcctgtgctgagcaacagagaaagctgtatcagagataaaaccaaacagatgaattacctcacaggattgctggtcaaagacactcggagagactccaggcatgtgacaagtctctcatctgcagaccccattttcagctcatgaatgaattcctgagattcaccatccaacggcaggaaatgaattgtgtaagttcaaaagaagatcaggtgaagtggtacgaaattcggtgtttttcatgttttttgtttttattaatttactataatgttattcaaaacaacattcccaataaagcaaaacaaattagcactgtaaaa

SEQ ID NO: 286165 - DNA, 350 bp, Homo sapiens
atgctctaaatcctcgtgtaggacgcccaacatctggacgcacacagcatgactactagtgctgagcagccacccacaatgaattacctcacaggattgctggtcaaagacactcggagagactccaggcatgtgacaagtctctcatctgcagaccccattttcagctcatgaatgaattcctgagattcaccatccaacggcaggaaatgaattgtgtaagttcaaaagaagatcaggtgaagtggtacgaaattcggtgtttttcatgttttttgtttttattaatttactataatgttattcaaaacaacattcccaataaagcaaaacaaattagcactgtaaaa

SEQ ID NO: 286166 - DNA, 870 bp, Homo sapiens
  misc_feature (841)..(841): n is a, c, g, or t
gagctcctgcaggtgggagtcgactcacctgcagcaggcactcggcacaactccgcaggaccggctcacctgcaccgggcactcagcacagcctccagcatgcagcgcctccccgctgccacccgggccaccctgatcctcagcctggcctttgcctccctccactcggcttgctcggcagaagcaagcagcagcaacagctcaagcttgaccgctcaccacccagaccctgggaccctggagcagtgcctcaacgtggacttctgcccacaagcagcccggtgctgccgcacaggagtggacgagtacggctggatcgcggcagctgttggctggagcctctggttcctcaccctcatcctgctctgtgtggacaaactgatgaagctgactccagatgagcccaaggacttgcaagcgtgagacccaggctcggtgcacaaaatggtgatcgccaccaatttgtggctaatggggaaggggagtaaggctaacatggtttctattatttaagtcattttcacctttaagcttcagttacttttacaagggaaagaagaaagagcgggagaaccaaataaggcaagccagtgctgcccttgcatgtcactcccaagggcccctgggctgtgcccaggtaactcctctctcaagatagtccctctgtaatgtatcctgttttaacctttcttctaggcaccaagggaggtgcacaagaaactataagacttagtctcatcatcaacattttcagaagcaagtgctgggattacaggcgtgagccaccgcgcccggcctcacgtgttgtattttcattcatatttcctttgggacttctttntggcccatgcattatttataaatatgttg

SEQ ID NO: 286167 - DNA, 4728 bp, Homo sapiens
gcggccgcggaggcccgtccgattgctgctccgcgctccgagcggctgtcggcgtgcgctatcgccccgccctggttagtgtctagccggccggcgaggcctgcgcagttgcagcggccggggaagatggtggaggacggcgcggaggagctggaggatctggtgcacttctccgtgtctgagttgcctagtcgcggctacggcgtcatggaggagatccggcggcagggcaagctgtgcgacgtgaccctcaagattggggaccacaaattcagtgcccaccggattgtcttagcagcctcgatcccgtatttccatgctatgtttacaaatgacatgatggagtgcaagcaggatgagattgtaatgcaaggaatggacccaagtgccctggaggctctgatcaactttgcctacaacggcaaccttgccattgaccagcaaaatgtccagtcattgctgatgggggcgagcttcctgcagctgcagagcatcaaagacgcctgctgcacattccttcgagaacggcttcacccaaaaaaactgcctgggtgtgcgccagtttgctgagacaatgatgtgtgctgtgctgtacgacgctgccaacagcttcatccaccagcactttgtggaggtgtccatgtcagaagagttcctggccctgcccttggaagacgtgcttgagctggtgtctcgggatgagctgaatgtcaaatctgaggagcaggtctttgaagctgcattggcctgggtcagatacgaccgggagcagaggggtccctacctgcctgagctgctgtccaatatccgcctgcccctctgtcggccccagttcctttcagacagagtacagcaggatgacctggtgcgttgctgccacaaatgcagggacctggtagacgaagcaaaggactaccacctcatgccagagcgccggccccacctgccagctttcagaacccggccacgctgctgcacatccatcgctggacttatctacgctgtagggggcctcaactcagcaggtgattccctgaatgtggtggaagtgttcgaccccattgccaattgctgggagagatgccgtcccatgacaacagcccgcagccgcgttggcgtggctgtggtgaacgggcttctctatgccatcggaggatatgacggccagctacggctgagcactgtggaggcctacaacccggagacagacacatggaccagagtggggagcatgaatagcaagagaagtgccatggggacagtcgtgctggatgggcagatctacgtctgtgggggctacgatggcaactcttccctcagctccgtggagacctactcacctgagacggacaaatggacagtggtgacctcgatgagctcgaatcgcagtgctgctggggttacagtctttgagggcaggatatatgtgtcaggcggccatgatggtttgcagatcttcagcagtgtggaacactacaaccaccacacagccacctggcaccctgcagctggcatgctcaacaagcgctgccggcacggagccgcctccctggggagcaagatgtttgtctgcgggggctacgatggctctggcttcctcagcattgccgagatgtacagctctgtggcagaccagtggtgcctgattgtccccatgcacacgcgcaggagccgggtctccctgggtggccagctgtgggcgcctctacgctgttgggggctacgacggacagtcaaacctaagctcagtggagatgtatgacccagagacagactgctggacattcatggcccccatggcgtgccatgagggaggggtcggtgtgggctgcatccctctcctcaccatctaaggcagaggatgggatgtggtggggcagggatctggtacagacataggcgcttccttccaggaacagtccctcaggagaggcagtggaccagaagagatggcgaaacgtgagctcgccggaggtacagtttttccaggtgcttaagccctccccaactgtgccacccttgtgaccttcaggcttgggtcatcaagatgcacagcatggaacacaagctcctctggatcctgcagctggtgacatggaactgttttctggtccacatgaacacaggctccatccaggcccagctcctacccaccgcctctctgtgggccagctgttcacagaaggccttccatctgatgctccccatcgcctgcttgctctccagccgagtctggccaatttgccatggggaggctgcagtgtccaagcctgctggaaactgggatgtagctggggacgaaaggacagacccaagcgttctccctgcctgagatggtgtggccacagcagtggaaggctgcacacaggcacattccttcttccacagtggggcaccaaggattctgtcctcattgctgggtaagcagggagaagagaagttttccccatgtctaattttgggatttcagtgaggccttttccatctgtccaggagaacagaagggaaaaaaagatacttgaaagaaactgaaggaaatttaaacaaagaaacacttgaaagaaactggaaagaaaaataatttttttatgtgaacaaattttgcaagaagaaaaaagcataaaagacactaacggcaaatctatgtttaaatggaaaatcgtctaactggagaagggcggtatccaccccacattcggatcccagggtcctgaggcctcgcattgagctgggggttccctctgagccccagtgtgtgtggaatcagtgcactcttgactgggcctgtagtaaggtgctcatggggtttgtcttctcacccaccatcagaggacttttaaaatcataggcgtagagagttagctatctgctgaattactgccactcttcttggtgggggctcctagctgtggctgggggctccaggcgcccctgtgattacctcctactgccaccatggcgctcattcagattccccactctcactaacattgcttccttttttgaccagcaggaaacagcaggtctggccagattctcacttgcccatcaatctcgttcttggatgatttccctcattgtgatgcttctggggcacgttgaccatatgcacctctagaacctaaccagggcttccttctaccagctgtgggcgggcttggtctggtaaccttgtctgctctgccattccactgctcctccatccactcgccaatcccaagagtctggcctccctccagccctgggcagactgaccagcaaggtggacctttacattcaagcacagctggcttttatgacataaagaactaaaggccgaaagaatctcttgctgctgcaaagaacagattttatatttcttcctctaatcttggcaaatgacctttaccttttggaaagatttcatattgcttcctcctccctggataggacctaatgtagcacagcgggactcaaagaggaggacattttctcttgccagtgcactgggcagtggggctgtccttcaactgctgctgccaaaattggttttctaaaattcttccagtagagactaaaagaagattcaattcctgtaacccaagactgagtcttagggctccagtctccacctgcttggtttcctatcctttgctgcctgcctggggtggcctggaagcctgttcagaaaggcacaatgtggagcctggggtgtctcccccaccccaggaccgtcaggtttaccagtgtgtgcaatcgccatgtattcagagggaagtacctttgttacctacaacttaggagctaggcctctgctacaagcacttgaaaatgatatttttatttttaacgtctcaacaatctgatatcggatgtcgtttaacctgggctcgtggtagggctccagcatttctccctccttcctggtttgcctgtaggggtagactcggaaggtgggtggggtgtgcatttcctgttaggagtgtatcagtgcttgtcttattataagcccctttcttttgtgaatttgaagtagcaccaacaagcctggattgtgaaggtattaagaatcggtctgtgggctactgagtgggtccttaggatactggcccagattttgccactgggtatggcagatcattttctaccatggcctgctgctcttgtagtggacttcctgagtccaatcccacctcctggtgtagaatttacactgctgcacctgaggtcgatgtttcaaagtaagatcaagccagtgttttgatctgggctctgagcacaagtcaggaaacaccaacatattcacactctcccagtaggttcctcagtccgatggtgaatggctattcgtaaatggctggtctggctctttggtgttggagcctttccaatagccccatgaaaagaagcatcacccaaggatattgtaaaaaggatgtaacaaggagatagggtagacattgtactcagtgggccttggggcctagcccagctctgagcagaggactgtggcattcactgtccttgagtgtttcaccttcttggataacacacgggccttctcttctggatttcatcagagattacagccagatgggggctgaagaccatcctcttgaccacagaggtgtgactgtgggaattcctcccaatttatggtttcccagaaaatcttagttccttttatttatagaatgcatgtcttttgtgttaagaaaccaaagagaaataaagagaacactcctaata

SEQ ID NO: 286168 - DNA, 4825 bp, Homo sapiens
  misc_feature (33)..(33): n is a, c, g, or t
tgaggatcccactagtcacggttggctcaggangttgatagttcttgggcagtgagagtgagtagtagaatgtttagtgagcctagggtgtggtgagtgtaaattagtgcgatgagtaggggaagtgaaaaaacgatcagagtagtggtatttcaccggcggcccgccctggttagtgtctagccggccggcgaggcctgcgcagttgcagcggccggggaagatggtggaggacggcgcggaggagctggaggatctggtgcacttctccgtgtctgagttgcctagtcgcggctacggcgtcatggaggagatccggcggcagggcaagctgtgcgacgtgaccctcaagattggggaccacaaattcagtgcccaccggattgtcttagcagcctcgatcccgtatttccatgctatgtttacaaatgacatgatggagtgcaagcaggatgagattgtaatgcaaggaatggacccaagtgccctggaggctctgatcaactttgcctacaacggcaaccttgccattgaccagcaaaatgtccagtcattgctgatgggggcgagcttcctgcagctgcagagcatcaaagacgcctgctgcacattccttcgagaacggcttcacccaaaaaaactgcctgggtgtgcgccagtttgctgagacaatgatgtgtgctgtgctgtacgacgctgccaacagcttcatccaccagcactttgtggaggtgtccatgtcagaagagttcctggccctgcccttggaagacgtgcttgagctggtgtctcgggatgagctgaatgtcaaatctgaggagcaggtctttgaagctgcattggcctgggtcagatacgaccgggagcagaggggtccctacctgcctgagctgctgtccaatatccgcctgcccctctgtcggccccagttcctttcagacagagtacagcaggatgacctggtgcgttgctgccacaaatgcagggacctggtagacgaagcaaaggactaccacctcatgccagagcgccggccccacctgccagctttcagaacccggccacgctgctgcacatccatcgctggacttatctacgctgtagggggcctcaactcagcaggtgattccctgaatgtggtggaagtgttcgaccccattgccaattgctgggagagatgccgtcccatgacaacagcccgcagccgcgttggcgtggctgtggtgaacgggcttctctatgccatcggaggatatgacggccagctacggctgagcactgtggaggcctacaacccggagacagacacatggaccagagtggggagcatgaatagcaagagaagtgccatggggacagtcgtgctggatgggcagatctacgtctgtgggggctacgatggcaactcttccctcagctccgtggagacctactcacctgagacggacaaatggacagtggtgacctcgatgagctcgaatcgcagtgctgctggggttacagtctttgagggcaggatatatgtgtcaggcggccatgatggtttgcagatcttcagcagtgtggaacactacaaccaccacacagccacctggcaccctgcagctggcatgctcaacaagcgctgccggcacggagccgcctccctggggagcaagatgtttgtctgcgggggctacgatggctctggcttcctcagcattgccgagatgtacagctctgtggcagaccagtggtgcctgattgtccccatgcacacgcgcaggagccgggtctccctgggtggccagctgtgggcgcctctacgctgttgggggctacgacggacagtcaaacctaagctcagtggagatgtatgacccagagacagactgctggacattcatggcccccatggcgtgccatgagggaggggtcggtgtgggctgcatccctctcctcaccatctaaggcagaggatgggatgtggtggggcagggatctggtacagacataggcgcttccttccaggaacagtccctcaggagaggcagtggaccagaagagatggcgaaacgtgagctcgccggaggtacagtttttccaggtgcttaagccctccccaactgtgccacccttgtgaccttcaggcttgggtcatcaagatgcacagcatggaacacaagctcctctggatcctgcagctggtgacatggaactgttttctggtccacatgaacacaggctccatccaggcccagctcctacccaccgcctctctgtgggccagctgttcacagaaggccttccatctgatgctccccatcgcctgcttgctctccagccgagtctggccaatttgccatggggaggctgcagtgtccaagcctgctggaaactgggatgtagctggggacgaaaggacagacccaagcgttctccctgcctgagatggtgtggccacagcagtggaaggctgcacacaggcacattccttcttccacagtggggcaccaaggattctgtcctcattgctgggtaagcagggagaagagaagttttccccatgtctaattttgggatttcagtgaggccttttccatctgtccaggagaacagaagggaaaaaaagatacttgaaagaaactgaaggaaatttaaacaaagaaacacttgaaagaaactggaaagaaaaataatttttttatgtgaacaaattttgcaagaagaaaaaagcataaaagacactaacggcaaatctatgtttaaatggaaaatcgtctaactggagaagggcggtatccaccccacattcggatcccagggtcctgaggcctcgcattgagctgggggttccctctgagccccagtgtgtgtggaatcagtgcactcttgactgggcctgtagtaaggtgctcatggggtttgtcttctcacccaccatcagaggacttttaaaatcataggcgtagagagttagctatctgctgaattactgccactcttcttggtgggggctcctagctgtggctgggggctccaggcgcccctgtgattacctcctactgccaccatggcgctcattcagattccccactctcactaacattgcttccttttttgaccagcaggaaacagcaggtctggccagattctcacttgcccatcaatctcgttcttggatgatttccctcattgtgatgcttctggggcacgttgaccatatgcacctctagaacctaaccagggcttccttctaccagctgtgggcgggcttggtctggtaaccttgtctgctctgccattccactgctcctccatccactcgccaatcccaagagtctggcctccctccagccctgggcagactgaccagcaaggtggacctttacattcaagcacagctggcttttatgacataaagaactaaaggccgaaagaatctcttgctgctgcaaagaacagattttatatttcttcctctaatcttggcaaatgacctttaccttttggaaagatttcatattgcttcctcctccctggataggacctaatgtagcacagcgggactcaaagaggaggacattttctcttgccagtgcactgggcagtggggctgtccttcaactgctgctgccaaaattggttttctaaaattcttccagtagagactaaaagaagattcaattcctgtaacccaagactgagtcttagggctccagtctccacctgcttggtttcctatcctttgctgcctgcctggggtggcctggaagcctgttcagaaaggcacaatgtggagcctggggtgtctcccccaccccaggaccgtcaggtttaccagtgtgtgcaatcgccatgtattcagagggaagtacctttgttacctacaacttaggagctaggcctctgctacaagcacttgaaaatgatatttttatttttaacgtctcaacaatctgatatcggatgtcgtttaacctgggctcgtggtagggctccagcatttctccctccttcctggtttgcctgtaggggtagactcggaaggtgggtggggtgtgcatttcctgttaggagtgtatcagtgcttgtcttattataagcccctttcttttgtgaatttgaagtagcaccaacaagcctggattgtgaaggtattaagaatcggtctgtgggctactgagtgggtccttaggatactggcccagattttgccactgggtatggcagatcattttctaccatggcctgctgctcttgtagtggacttcctgagtccaatcccacctcctggtgtagaatttacactgctgcacctgaggtcgatgtttcaaagtaagatcaagccagtgttttgatctgggctctgagcacaagtcaggaaacaccaacatattcacactctcccagtaggttcctcagtccgatggtgaatggctattcgtaaatggctggtctggctctttggtgttggagcctttccaatagccccatgaaaagaagcatcacccaaggatattgtaaaaaggatgtaacaaggagatagggtagacattgtactcagtgggccttggggcctagcccagctctgagcagaggactgtggcattcactgtccttgagtgtttcaccttcttggataacacacgggccttctcttctggatttcatcagagattacagccagatgggggctgaagaccatcctcttgaccacagaggtgtgactgtgggaattcctcccaatttatggtttcccagaaaatcttagttccttttatttatagaatgcatgtcttttgtgttaagaaaccaaagagaaataaagagaacactcctaata

SEQ ID NO: 286169 - DNA, 4375 bp, Homo sapiens
acgatcgcttacatgatcggtacacgtacccagtgccctggaggctctgatcaactttgcctacaacggcaaccttgccattgaccagcaaaatgtccagtcattgctgatgggggcgagcttcctgcagctgcagagcatcaaagacgcctgctgcacattccttcgagaacggcttcacccaaaaaaactgcctgggtgtgcgccagtttgctgagacaatgatgtgtgctgtgctgtacgacgctgccaacagcttcatccaccagcactttgtggaggtgtccatgtcagaagagttcctggccctgcccttggaagacgtgcttgagctggtgtctcgggatgagctgaatgtcaaatctgaggagcaggtctttgaagctgcattggcctgggtcagatacgaccgggagcagaggggtccctacctgcctgagctgctgtccaatatccgcctgcccctctgtcggccccagttcctttcagacagagtacagcaggatgacctggtgcgttgctgccacaaatgcagggacctggtagacgaagcaaaggactaccacctcatgccagagcgccggccccacctgccagctttcagaacccggccacgctgctgcacatccatcgctggacttatctacgctgtagggggcctcaactcagcaggtgattccctgaatgtggtggaagtgttcgaccccattgccaattgctgggagagatgccgtcccatgacaacagcccgcagccgcgttggcgtggctgtggtgaacgggcttctctatgccatcggaggatatgacggccagctacggctgagcactgtggaggcctacaacccggagacagacacatggaccagagtggggagcatgaatagcaagagaagtgccatggggacagtcgtgctggatgggcagatctacgtctgtgggggctacgatggcaactcttccctcagctccgtggagacctactcacctgagacggacaaatggacagtggtgacctcgatgagctcgaatcgcagtgctgctggggttacagtctttgagggcaggatatatgtgtcaggcggccatgatggtttgcagatcttcagcagtgtggaacactacaaccaccacacagccacctggcaccctgcagctggcatgctcaacaagcgctgccggcacggagccgcctccctggggagcaagatgtttgtctgcgggggctacgatggctctggcttcctcagcattgccgagatgtacagctctgtggcagaccagtggtgcctgattgtccccatgcacacgcgcaggagccgggtctccctgggtggccagctgtgggcgcctctacgctgttgggggctacgacggacagtcaaacctaagctcagtggagatgtatgacccagagacagactgctggacattcatggcccccatggcgtgccatgagggaggggtcggtgtgggctgcatccctctcctcaccatctaaggcagaggatgggatgtggtggggcagggatctggtacagacataggcgcttccttccaggaacagtccctcaggagaggcagtggaccagaagagatggcgaaacgtgagctcgccggaggtacagtttttccaggtgcttaagccctccccaactgtgccacccttgtgaccttcaggcttgggtcatcaagatgcacagcatggaacacaagctcctctggatcctgcagctggtgacatggaactgttttctggtccacatgaacacaggctccatccaggcccagctcctacccaccgcctctctgtgggccagctgttcacagaaggccttccatctgatgctccccatcgcctgcttgctctccagccgagtctggccaatttgccatggggaggctgcagtgtccaagcctgctggaaactgggatgtagctggggacgaaaggacagacccaagcgttctccctgcctgagatggtgtggccacagcagtggaaggctgcacacaggcacattccttcttccacagtggggcaccaaggattctgtcctcattgctgggtaagcagggagaagagaagttttccccatgtctaattttgggatttcagtgaggccttttccatctgtccaggagaacagaagggaaaaaaagatacttgaaagaaactgaaggaaatttaaacaaagaaacacttgaaagaaactggaaagaaaaataatttttttatgtgaacaaattttgcaagaagaaaaaagcataaaagacactaacggcaaatctatgtttaaatggaaaatcgtctaactggagaagggcggtatccaccccacattcggatcccagggtcctgaggcctcgcattgagctgggggttccctctgagccccagtgtgtgtggaatcagtgcactcttgactgggcctgtagtaaggtgctcatggggtttgtcttctcacccaccatcagaggacttttaaaatcataggcgtagagagttagctatctgctgaattactgccactcttcttggtgggggctcctagctgtggctgggggctccaggcgcccctgtgattacctcctactgccaccatggcgctcattcagattccccactctcactaacattgcttccttttttgaccagcaggaaacagcaggtctggccagattctcacttgcccatcaatctcgttcttggatgatttccctcattgtgatgcttctggggcacgttgaccatatgcacctctagaacctaaccagggcttccttctaccagctgtgggcgggcttggtctggtaaccttgtctgctctgccattccactgctcctccatccactcgccaatcccaagagtctggcctccctccagccctgggcagactgaccagcaaggtggacctttacattcaagcacagctggcttttatgacataaagaactaaaggccgaaagaatctcttgctgctgcaaagaacagattttatatttcttcctctaatcttggcaaatgacctttaccttttggaaagatttcatattgcttcctcctccctggataggacctaatgtagcacagcgggactcaaagaggaggacattttctcttgccagtgcactgggcagtggggctgtccttcaactgctgctgccaaaattggttttctaaaattcttccagtagagactaaaagaagattcaattcctgtaacccaagactgagtcttagggctccagtctccacctgcttggtttcctatcctttgctgcctgcctggggtggcctggaagcctgttcagaaaggcacaatgtggagcctggggtgtctcccccaccccaggaccgtcaggtttaccagtgtgtgcaatcgccatgtattcagagggaagtacctttgttacctacaacttaggagctaggcctctgctacaagcacttgaaaatgatatttttatttttaacgtctcaacaatctgatatcggatgtcgtttaacctgggctcgtggtagggctccagcatttctccctccttcctggtttgcctgtaggggtagactcggaaggtgggtggggtgtgcatttcctgttaggagtgtatcagtgcttgtcttattataagcccctttcttttgtgaatttgaagtagcaccaacaagcctggattgtgaaggtattaagaatcggtctgtgggctactgagtgggtccttaggatactggcccagattttgccactgggtatggcagatcattttctaccatggcctgctgctcttgtagtggacttcctgagtccaatcccacctcctggtgtagaatttacactgctgcacctgaggtcgatgtttcaaagtaagatcaagccagtgttttgatctgggctctgagcacaagtcaggaaacaccaacatattcacactctcccagtaggttcctcagtccgatggtgaatggctattcgtaaatggctggtctggctctttggtgttggagcctttccaatagccccatgaaaagaagcatcacccaaggatattgtaaaaaggatgtaacaaggagatagggtagacattgtactcagtgggccttggggcctagcccagctctgagcagaggactgtggcattcactgtccttgagtgtttcaccttcttggataacacacgggccttctcttctggatttcatcagagattacagccagatgggggctgaagaccatcctcttgaccacagaggtgtgactgtgggaattcctcccaatttatggtttcccagaaaatcttagttccttttatttatagaatgcatgtcttttgtgttaagaaaccaaagagaaataaagagaacactcctaata

SEQ ID NO: 286170 - DNA, 3931 bp, Homo sapiens
  misc_feature (30)..(30): n is a, c, g, or t
ggctaggtacgaggctgggtttgaatcggncgaggttcctttcagacagagtacagcaggatgacctggtgcgttgctgccacaaatgcagggacctggtagacgaagcaaaggactaccacctcatgccagagcgccggccccacctgccagctttcagaacccggccacgctgctgcacatccatcgctggacttatctacgctgtagggggcctcaactcagcaggtgattccctgaatgtggtggaagtgttcgaccccattgccaattgctgggagagatgccgtcccatgacaacagcccgcagccgcgttggcgtggctgtggtgaacgggcttctctatgccatcggaggatatgacggccagctacggctgagcactgtggaggcctacaacccggagacagacacatggaccagagtggggagcatgaatagcaagagaagtgccatggggacagtcgtgctggatgggcagatctacgtctgtgggggctacgatggcaactcttccctcagctccgtggagacctactcacctgagacggacaaatggacagtggtgacctcgatgagctcgaatcgcagtgctgctggggttacagtctttgagggcaggatatatgtgtcaggcggccatgatggtttgcagatcttcagcagtgtggaacactacaaccaccacacagccacctggcaccctgcagctggcatgctcaacaagcgctgccggcacggagccgcctccctggggagcaagatgtttgtctgcgggggctacgatggctctggcttcctcagcattgccgagatgtacagctctgtggcagaccagtggtgcctgattgtccccatgcacacgcgcaggagccgggtctccctgggtggccagctgtgggcgcctctacgctgttgggggctacgacggacagtcaaacctaagctcagtggagatgtatgacccagagacagactgctggacattcatggcccccatggcgtgccatgagggaggggtcggtgtgggctgcatccctctcctcaccatctaaggcagaggatgggatgtggtggggcagggatctggtacagacataggcgcttccttccaggaacagtccctcaggagaggcagtggaccagaagagatggcgaaacgtgagctcgccggaggtacagtttttccaggtgcttaagccctccccaactgtgccacccttgtgaccttcaggcttgggtcatcaagatgcacagcatggaacacaagctcctctggatcctgcagctggtgacatggaactgttttctggtccacatgaacacaggctccatccaggcccagctcctacccaccgcctctctgtgggccagctgttcacagaaggccttccatctgatgctccccatcgcctgcttgctctccagccgagtctggccaatttgccatggggaggctgcagtgtccaagcctgctggaaactgggatgtagctggggacgaaaggacagacccaagcgttctccctgcctgagatggtgtggccacagcagtggaaggctgcacacaggcacattccttcttccacagtggggcaccaaggattctgtcctcattgctgggtaagcagggagaagagaagttttccccatgtctaattttgggatttcagtgaggccttttccatctgtccaggagaacagaagggaaaaaaagatacttgaaagaaactgaaggaaatttaaacaaagaaacacttgaaagaaactggaaagaaaaataatttttttatgtgaacaaattttgcaagaagaaaaaagcataaaagacactaacggcaaatctatgtttaaatggaaaatcgtctaactggagaagggcggtatccaccccacattcggatcccagggtcctgaggcctcgcattgagctgggggttccctctgagccccagtgtgtgtggaatcagtgcactcttgactgggcctgtagtaaggtgctcatggggtttgtcttctcacccaccatcagaggacttttaaaatcataggcgtagagagttagctatctgctgaattactgccactcttcttggtgggggctcctagctgtggctgggggctccaggcgcccctgtgattacctcctactgccaccatggcgctcattcagattccccactctcactaacattgcttccttttttgaccagcaggaaacagcaggtctggccagattctcacttgcccatcaatctcgttcttggatgatttccctcattgtgatgcttctggggcacgttgaccatatgcacctctagaacctaaccagggcttccttctaccagctgtgggcgggcttggtctggtaaccttgtctgctctgccattccactgctcctccatccactcgccaatcccaagagtctggcctccctccagccctgggcagactgaccagcaaggtggacctttacattcaagcacagctggcttttatgacataaagaactaaaggccgaaagaatctcttgctgctgcaaagaacagattttatatttcttcctctaatcttggcaaatgacctttaccttttggaaagatttcatattgcttcctcctccctggataggacctaatgtagcacagcgggactcaaagaggaggacattttctcttgccagtgcactgggcagtggggctgtccttcaactgctgctgccaaaattggttttctaaaattcttccagtagagactaaaagaagattcaattcctgtaacccaagactgagtcttagggctccagtctccacctgcttggtttcctatcctttgctgcctgcctggggtggcctggaagcctgttcagaaaggcacaatgtggagcctggggtgtctcccccaccccaggaccgtcaggtttaccagtgtgtgcaatcgccatgtattcagagggaagtacctttgttacctacaacttaggagctaggcctctgctacaagcacttgaaaatgatatttttatttttaacgtctcaacaatctgatatcggatgtcgtttaacctgggctcgtggtagggctccagcatttctccctccttcctggtttgcctgtaggggtagactcggaaggtgggtggggtgtgcatttcctgttaggagtgtatcagtgcttgtcttattataagcccctttcttttgtgaatttgaagtagcaccaacaagcctggattgtgaaggtattaagaatcggtctgtgggctactgagtgggtccttaggatactggcccagattttgccactgggtatggcagatcattttctaccatggcctgctgctcttgtagtggacttcctgagtccaatcccacctcctggtgtagaatttacactgctgcacctgaggtcgatgtttcaaagtaagatcaagccagtgttttgatctgggctctgagcacaagtcaggaaacaccaacatattcacactctcccagtaggttcctcagtccgatggtgaatggctattcgtaaatggctggtctggctctttggtgttggagcctttccaatagccccatgaaaagaagcatcacccaaggatattgtaaaaaggatgtaacaaggagatagggtagacattgtactcagtgggccttggggcctagcccagctctgagcagaggactgtggcattcactgtccttgagtgtttcaccttcttggataacacacgggccttctcttctggatttcatcagagattacagccagatgggggctgaagaccatcctcttgaccacagaggtgtgactgtgggaattcctcccaatttatggtttcccagaaaatcttagttccttttatttatagaatgcatgtcttttgtgttaagaaaccaaagagaaataaagagaacactcctaata

SEQ ID NO: 286171 - DNA, 3525 bp, Homo sapiens
tcactacctagcattgcatccttgggcacatcctttttgtttccttagatgcaaacagaaagggttaggtgaggtgacctctccctgtccccatacaccaaagagcaggcctgcagcagagggaatactgggagagctccttttccccatacctcccacaggagtttgacatcatggggggctgctgtgccctgcacggtcactccatggactgagctttgcctctgactgtcctgtacctgtgcctctctccccactgcaggtggaacactacaaccaccacacagccacctggcaccctgcagctggcatgctcaacaagcgctgccggcacggagccgcctccctggggagcaagatgtttgtctgcgggggctacgatggctctggcttcctcagcattgccgagatgtacagctctgtggcagaccagtggtgcctgattgtccccatgcacacgcgcaggagccgggtctccctgggtggccagctgtgggcgcctctacgctgttgggggctacgacggacagtcaaacctaagctcagtggagatgtatgacccagagacagactgctggacattcatggcccccatggcgtgccatgagggaggggtcggtgtgggctgcatccctctcctcaccatctaaggcagaggatgggatgtggtggggcagggatctggtacagacataggcgcttccttccaggaacagtccctcaggagaggcagtggaccagaagagatggcgaaacgtgagctcgccggaggtacagtttttccaggtgcttaagccctccccaactgtgccacccttgtgaccttcaggcttgggtcatcaagatgcacagcatggaacacaagctcctctggatcctgcagctggtgacatggaactgttttctggtccacatgaacacaggctccatccaggcccagctcctacccaccgcctctctgtgggccagctgttcacagaaggccttccatctgatgctccccatcgcctgcttgctctccagccgagtctggccaatttgccatggggaggctgcagtgtccaagcctgctggaaactgggatgtagctggggacgaaaggacagacccaagcgttctccctgcctgagatggtgtggccacagcagtggaaggctgcacacaggcacattccttcttccacagtggggcaccaaggattctgtcctcattgctgggtaagcagggagaagagaagttttccccatgtctaattttgggatttcagtgaggccttttccatctgtccaggagaacagaagggaaaaaaagatacttgaaagaaactgaaggaaatttaaacaaagaaacacttgaaagaaactggaaagaaaaataatttttttatgtgaacaaattttgcaagaagaaaaaagcataaaagacactaacggcaaatctatgtttaaatggaaaatcgtctaactggagaagggcggtatccaccccacattcggatcccagggtcctgaggcctcgcattgagctgggggttccctctgagccccagtgtgtgtggaatcagtgcactcttgactgggcctgtagtaaggtgctcatggggtttgtcttctcacccaccatcagaggacttttaaaatcataggcgtagagagttagctatctgctgaattactgccactcttcttggtgggggctcctagctgtggctgggggctccaggcgcccctgtgattacctcctactgccaccatggcgctcattcagattccccactctcactaacattgcttccttttttgaccagcaggaaacagcaggtctggccagattctcacttgcccatcaatctcgttcttggatgatttccctcattgtgatgcttctggggcacgttgaccatatgcacctctagaacctaaccagggcttccttctaccagctgtgggcgggcttggtctggtaaccttgtctgctctgccattccactgctcctccatccactcgccaatcccaagagtctggcctccctccagccctgggcagactgaccagcaaggtggacctttacattcaagcacagctggcttttatgacataaagaactaaaggccgaaagaatctcttgctgctgcaaagaacagattttatatttcttcctctaatcttggcaaatgacctttaccttttggaaagatttcatattgcttcctcctccctggataggacctaatgtagcacagcgggactcaaagaggaggacattttctcttgccagtgcactgggcagtggggctgtccttcaactgctgctgccaaaattggttttctaaaattcttccagtagagactaaaagaagattcaattcctgtaacccaagactgagtcttagggctccagtctccacctgcttggtttcctatcctttgctgcctgcctggggtggcctggaagcctgttcagaaaggcacaatgtggagcctggggtgtctcccccaccccaggaccgtcaggtttaccagtgtgtgcaatcgccatgtattcagagggaagtacctttgttacctacaacttaggagctaggcctctgctacaagcacttgaaaatgatatttttatttttaacgtctcaacaatctgatatcggatgtcgtttaacctgggctcgtggtagggctccagcatttctccctccttcctggtttgcctgtaggggtagactcggaaggtgggtggggtgtgcatttcctgttaggagtgtatcagtgcttgtcttattataagcccctttcttttgtgaatttgaagtagcaccaacaagcctggattgtgaaggtattaagaatcggtctgtgggctactgagtgggtccttaggatactggcccagattttgccactgggtatggcagatcattttctaccatggcctgctgctcttgtagtggacttcctgagtccaatcccacctcctggtgtagaatttacactgctgcacctgaggtcgatgtttcaaagtaagatcaagccagtgttttgatctgggctctgagcacaagtcaggaaacaccaacatattcacactctcccagtaggttcctcagtccgatggtgaatggctattcgtaaatggctggtctggctctttggtgttggagcctttccaatagccccatgaaaagaagcatcacccaaggatattgtaaaaaggatgtaacaaggagatagggtagacattgtactcagtgggccttggggcctagcccagctctgagcagaggactgtggcattcactgtccttgagtgtttcaccttcttggataacacacgggccttctcttctggatttcatcagagattacagccagatgggggctgaagaccatcctcttgaccacagaggtgtgactgtgggaattcctcccaatttatggtttcccagaaaatcttagttccttttatttatagaatgcatgtcttttgtgttaagaaaccaaagagaaataaagagaacactcctaata

SEQ ID NO: 286172 - DNA, 3312 bp, Homo sapiens
gcggccgcggaggcccgtccgattgctgctccgcgctccgagcggctgtcggcgtgcgctatcgccccgccctggttagtgtctagccggccggcgaggcctgcgcagttgcagcggccggggaagatggtggaggacggcgcggaggagctggaggatctggtgcacttctccgtgtctgagttgcctagtcgcggctacggcgtcatggaggagatccggcggcagggcaagctgtgcgacgtgaccctcaagattggggaccacaaattcagtgcccaccggattgtcttagcagcctcgatcccgtatttccatgctatgtttacaaatgacatgatggagtgcaagcaggatgagattgtaatgcaaggaatggacccaagtgccctggaggctctgatcaactttgcctacaacggcaaccttgccattgaccagcaaaatgtccagtcattgctgatgggggcgagcttcctgcagctgcagagcatcaaagacgcctgctgcacattccttcgagaacggcttcacccaaaaaaactgcctgggtgtgcgccagtttgctgagacaatgatgtgtgctgtgctgtacgacgctgccaacagcttcatccaccagcactttgtggaggtgtccatgtcagaagagttcctggccctgcccttggaagacgtgcttgagctggtgtctcgggatgagctgaatgtcaaatctgaggagcaggtctttgaagctgcattggcctgggtcagatacgaccgggagcagaggggtccctacctgcctgagctgctgtccaatatccgcctgcccctctgtcggccccagttcctttcagacagagtacagcaggatgacctggtgcgttgctgccacaaatgcagggacctggtagacgaagcaaaggactaccacctcatgccagagcgccggccccacctgccagctttcagaacccggccacgctgctgcacatccatcgctggacttatctacgctgtagggggcctcaactcagcaggtgattccctgaatgtggtggaagtgttcgaccccattgccaattgctgggagagatgccgtcccatgacaacagcccgcagccgcgttggcgtggctgtggtgaacgggcttctctatgccatcggaggatatgacggccagctacggctgagcactgtggaggcctacaacccggagacagacacatggaccagagtggggagcatgaatagcaagagaaggtattctggaagccacgtgcagcccgaacatacacactgagcacctggggagcgccatgctagacgagcaggggcacacagtagagtaaaatacaagctttggcctgggagtttcctgcagccaggccagccactgccagtacctcctgggagcgagcccccatctgcttaaaagtaaaatatccaccttgtcctttggggaacttggggagaccaggcgtggacatgtggaagttgtgttgttattttaagtgccagataaggactggaaatgtgtattatggaagattcgaagagggagagaaactggactggaacttctggaagatttcagggaagaggtgggattaaagttgaaacttgaagaataaggaggatttacctttattagtgataaaaggaaatccaaggtgtttttctgtgtaccttccttccccaggactcccctcacacatgcacttccactacctggggagaatacgaaccaaagcaatgttcttttatttaggtcacacacattctcccagacaggagcacataggtatttgcaaggtgggccaagttgatatgtcactcagtacattctagctacctgctctctccacttctctgcttatattgtctgaataagaagtgggattagaagacatcccagtgcctttgtttagcccttcttactgctgaggtgacaggtggcatgtttcattatgtcagacacgtgatggagtcatcacatgtgtgggcagctgaaaagctggcgcagcccaaggaggggagaggaaagctgcccagggccccctggccgttacccaggacagctctgcactgattgcttttacacattgagcttccttgatatatgcctaatgttgttccacatccagcagcgtttgcatgtggatgtgagctgggagggatctgcctttgtactggtgagaccagttcacaaagcatcggagtaggttcctttgggaagaaaaaaatacgtaagatctgccctcccaagaacgcgttgagagtcctttcctcccaccatccccacttttgctccttggatactttgcagcttcctatgtttgagtgactcattgctccgtgtccccaaccatgagtagcttttttgctttgactgcagtcagctgtccttccttgtgtgtctgctctggaccacttccttgctttgatgttactgggtttagagggctgtcttggaggaaagttctctgggtattcctttccttcactgtggttaatatcctgttattagtgtgggcccggttccattacatcccttttaaattacaggctaccttaaaacgttcctagtcacttctcttctgacatcccacacagctgtctgttctgccagttagtgacatcctgccatctttccttcctatctcccccagtgttctacgccatcccatagacctttcttacactggactattccagtccatgctgatcagcattttctccttctcttcacactcgcctttaccacctagttgatagttaatctcatgcagttttggggcacctcttaattcattttcatattgttctacacctgttttgttatgtaatttttatgtttgttttgtgtccgtatccagaaggatagtgatcatgtctagtaaatttgtgatcttcccacaatacttgcctaaggcaagtccctctcctctttctggctggttcagggggtcagttatcatgtccctgaaagggacattctgtggatcagtttgattactatgtacatttaaaaggtagcagcaagccaggtatggtggctcacgcctataatcccagcactttgcgaggccaaggagggcggatcacctaaggtcaggagtttgagaccagcctggccaacatggtgaaaccctgtctttactaaaaatacaaaaattagccaggcatggtggcgggcgcctgttatcccagctacttgggaggctaaggcagggagaattgcttaaaccggggaggcgggggttgcaatgagctaagatcgtgccactgcattccagcctggttgacagagtgagactccgtctc

SEQ ID NO: 286173 - DNA, 1928 bp, Homo sapiens
gcggccgcggaggcccgtccgattgctgctccgcgctccgagcggctgtcggcgtgcgctatcgccccgccctggttagtgtctagccggccggcgaggcctgcgcagttgcagcggccggggaagatggtggaggacggcgcggaggagctggaggatctggtgcacttctccgtgtctgagttgcctagtcgcggctacggcgtcatggaggagatccggcggcagggcaagctgtgcgacgtgaccctcaagattggggaccacaaattcagtgcccaccggattgtcttagcagcctcgatcccgtatttccatgctatgtttacaaatgacatgatggagtgcaagcaggatgagattgtaatgcaaggaatggacccaagtgccctggaggctctgatcaactttgcctacaacggcaaccttgccattgaccagcaaaatgtccagtcattgctgatgggggcgagcttcctgcagctgcagagcatcaaagacgcctgctgcacattccttcgagaacggcttcacccaaaaaaactgcctgggtgtgcgccagtttgctgagacaatgatgtgtgctgtgctgtacgacgctgccaacagcttcatccaccagcactttgtggaggtgtccatgtcagaagagttcctggccctgcccttggaagacgtgcttgagctggtgtctcgggatgagctgaatgtcaaatctgaggagcaggtctttgaagctgcattggcctgggtcagatacgaccgggagcagaggggtccctacctgcctgagctgctgtccaatatccgcctgcccctctgtcggccccagttcctttcagacagagtacagcaggatgacctggtgcgttgctgccacaaatgcagggacctggtagacgaagcaaaggactaccacctcatgccagagcgccggccccacctgccagctttcagaacccggccacgctgctgcacatccatcgctggacttatctacgctgtagggggcctcaactcagcaggtgattccctgaatgtggtggaagtgttcgaccccattgccaattgctgggagagatgccgtcccatgacaacagcccgcagccgcgttggcgtggctgtggtgaacgggcttctctatgccatcggaggatatgacggccagctacggctgagcactgtggaggcctacaacccggagacagacacatggaccagagtggggagcatgaatagcaagagaagtgccatggggacagtcgtgctggatgggcagatctacgtctgtgggggctacgatggcaactcttccctcagctccgtggagacctactcacctgagacggacaaatggacagtggtgacctcgatgagctcgaatcgcagtgctgctggggttacagtctttgagggcaggatatatgtgtcaggcggccatgatggtttgcagatcttcagcagtgtggaacaataaaacaacacacagcactggaacctgaagttggcaattgtccaaaagggcttgccgagacggagccggcttccctgggggagcaagaatgttcggccttggggggctacaaaaggaccagggttcctccacgaattgcgcaaatgtcacgtccttggcaacccactgtgcttattgtgtcccatggtacaagccaaagagaccggaatccccgggggcacccatgagcggcccaagaggagggggggaacaaaggaacggacaacccaccaccaccgcgaacctgtagcaccacgaagaaacagcggtgagaataagagcaccaagcagcgaacacaaaagacgacgacagggcgcaacaaccccaccaaaaagaaagagagacgacgagcgagcaaagacaaaaccgagcaacgcacacacaccaggaaagaagcgtgacccactgcacatg

SEQ ID NO: 286174 - DNA, 682 bp, Homo sapiens
atgagaggtcaggggtagggcactggtagtggggatgggagcaagcactgactaggaagcaaaccagccaggacttgggggaccacaggaatgttgatggtgagggagaagcagccagaatagcactgagctttataagtacagcagctagagggctggtggtctgcttaacaaggcagggagtgcagggaggagcagaactgtaggagaaagaggtcttgtatgagacaatgattttgagcagccatggagatgagcagagaagatgggctgtgggtttgcagcttgggtgagaggcggcagccagggagaactgtcagagaggtggtgggagaggtgataagagatggagagatggccagcacagttcacctaaaccctgctaggctgtcttgagggaacaagaaccctgaatctcatgcttcccctcctattttgactctttcctgaagatggacagtggtgacctcgatgagctcgaatcgcagtgctgctggggttacagtctttgagggcaggatatatgtgtcaggcggccatgatggtttgcagatcttcagcagtgtgagtctgggctccccctgggataagggtacctacttctgtctttgagatttattttagaagatcattatttgaaaaaacttcagccttgccacagctgaataaagtatcatctagt

SEQ ID NO: 286175 - DNA, 936 bp, Homo sapiens
cgcacttagcagtgccagtggcagcagcagccatggggaagccgggcgtggaggcagcaccgggctcggagctggccagggttccctagcctatggagcacgcagccaccacaggccccaggcctggacctccctctcggcgggtggagaatgttgtgctacgagccaaggactggctgccaggagctcctgggggcaccgcagtgtgggccaccagcttggaagcagaggtcccaccagatctagcgctcaataaggagcagcagctgcagatctccaaggagctggtcgacattcagatcacaacccaccacctacatgagcagcatgaggctgaaatcttccagctgaagagtgagatccttcggctggagagccgggtactggagctggagctgcgaggagatggcaccagccagggctgtgcagtcccagtggagtctgaccccaggcatccccgggcagcagcccaagagctcagacacaaagcccaggtgcctggacactctgatgaccacagattccaggtgcagcccaagaacaccatgaaccccgagaatgagcagcacaggctggggagcggcctgcagggggaagtgaagtgggcgctggagcatcaggaggcccggcagcaggcactggtgacgcgtgtgtgagtggccatctcacctggggccccatcctggagcagagagaacccctgatcgtgggcctgctgagcctcacccccgtgtcttcagggcaaccctgggccggcagctgcagggagcccgagaggaggccagggcagccgggcagcgactggccacacaggctgtggtgctgtgcagctgccaaggccagctccgtcaggcagaggctgaaaatgcccggctgcagctgcagctcaagaaactgaaggatgagtacgtcctacggctgcaacactgcgcctgg

SEQ ID NO: 286176 - DNA, 848 bp, Homo sapiens
cgcacttagcagtgccagtggcagcagcagccatggggaagccgggcgtggaggcagcaccgggctcggagctggccagggttccctagcctatggagcacgcagccaccacaggccccaggcctggacctccctctcggcgggtggagaatgttgtgctacgagccaaggactggctgccaggagctcctgggggcaccgcagtgtgggccaccagcttggaagcagaggtcccaccagatctagcgctcaataaggagcagcagctgcagatctccaaggagctggtcgacattcagatcacaacccaccacctacatgagcagcatgaggctgaaatcttccagctgaagagtgagatccttcggctggagagccgggtactggagctggagctgcgaggagatggcaccagccagggctgtgcagtcccagtggagtctgaccccaggcatccccgggcagcagcccaagagctcagacacaaagcccaggtgcctggacactctgatgaccacagattccaggtgcagcccaagaacaccatgaaccccgagaatgagcagcacaggctggggagcggcctgcagggggaagtgaagtgggcgctggagcatcaggaggcccggcagcaggcactggtgacgcgtgtggcaaccctgggccggcagctgcagggagcccgagaggaggccagggcagccgggcagcgactggccacacaggctgtggtgctgtgcagctgccaaggccagctccgtcaggcagaggctgaaaatgcccggctgcagctgcagctcaagaaactgaaggatgagtacgtcctacggctgcaacactgcgcctgg

SEQ ID NO: 286177 - DNA, 954 bp, Homo sapiens
ccgccggcggtgcgcgtgcccggtggggcgccacgcgcacgctccgaccccgccgcgcccggcgctggcacctcctccaggaagccctcccgacgccccggctgagccagtcgtttccgagttctccggcccctgatggggacgtctgcgcccctcttctcaggccagaggttgtgctacgagccaaggactggctgccaggagctcctgggggcaccgcagtgtgggccaccagcttggaagcagaggtcccaccagatctagcgctcaataaggagcagcagctgcagatctccaaggagctggtcgacattcagatcacaacccaccacctacatgagcagcatgaggctgaaatcttccagctgaagagtgagatccttcggctggagagccgggtactggagctggagctgcgaggagatggcaccagccagggctgtgcagtcccagtggagtctgaccccaggcatccccgggcagcagcccaagagctcagacacaaagcccaggtgcctggacactctgatgaccacagattccaggtgcagcccaagaacaccatgaaccccgagaatgagcagcacaggctggggagcggcctgcagggggaagtgaagtgggcgctggagcatcaggaggcccggcagcaggcactggtgacgcgtgtgtgagtggccatctcacctggggccccatcctggagcagagagaacccctgatcgtgggcctgctgagcctcacccccgtgtcttcagggcaaccctgggccggcagctgcagggagcccgagaggaggccagggcagccgggcagcgactggccacacaggctgtggtgctgtgcagctgccaaggccagctccgtcaggcagaggctgaaaatgcccggctgcagctgcagctcaagaaactgaaggatgagtacgtcctacggctgcaacactgcgcctgg

SEQ ID NO: 286178 - DNA, 562 bp, Homo sapiens
gagaatgagcagcacaggctggggagcggcgtgagtgtgcagccacctagctcaggggagagggcagcaccagagaccccaagcctagggtctcatccagccagccctgtgtgccccacagctgcagggggaagtgaagtgggcgctggagcatcaggaggcccggcagcaggcactggtgacgcgtgtgtgagtggccatctcacctggggccccatcctggagcagagagaacccctgatcgtgggcctgctgagcctcacccccgtgtcttcagggcaaccctgggccggcagctgcagggagcccgagaggaggccagggcagccgggcagcgactggccacacaggctgtggtgaggctctgccctgactgcttggagacctggagggtgggggccccagaagctcagccggggtccactctcagggcacaggtggagggctgcttccaccccaggtgctgtgcagctgccaaggccagctccgtcaggcagaggctgaaaatgcccggctgcagctgcagctcaagaaactgaaggatgagtacgtcctacggctg

SEQ ID NO: 286179 - DNA, 668 bp, Homo sapiens
gcgtacgtactactactactaaattcgcggccgcgtcgacgaagggctcccttgagaactaggacaagagactacaaggagtatgtcctgaggaggggttgggatggtgtgttttctctcacctcccttttatgagggtcctcttgtccatcttcaagcctcacagtgggggcttgcagaggagtgcagactgaagccagcagagaggaaggactgactgaggggctgtgtcctcttatgggaatttgggaacatccctcgtcttgtcctctcttctgcacagcacaggttccagcactggttttagaagaaaaaaataccctgcccagagggaaagccaggaaagattgggaagtgggtggtcaggagagaaggcctgataggagccttcagacaatttgggtcctagttgcttgggttggacaatacaggaattgcttctgggccctgggaaagctgggaccatagtgctccagcccaaagactaggggagcattcattaccctagtttgacctgaaaatccatagggcagggcccactactttccaaagaaataaaagaacaattatttttaacaaatgggagaaaaaaaaaaagctcaccaattttttcgttcgacccggccgcgaatttaataagtagtaatccgaccccggaaatttccgga

SEQ ID NO: 286180 - DNA, 2998 bp, Homo sapiens
ggaagcggaagagcgatcgggtaggcggctctttgtcgaagctagaggaccggcaggcggcagcagcaactacggcggcggcggcagaacccagcagtgatgtggaggtggagacccacaggagccccggacttcacctgagctacctcagtggtcaccaagagtggcaagataaagaaaaccctgagttgggcgggaccaggatgcctgaccgggacagctatgccaacggtaccgggagcagcggtggaggccctggaggtggtggcagcgaggaggccagtggggcaggggtaggcagtggcggggccagctcagatgccatctgtagagacttcttgaggaatgtgtgcaagcgaggcaagcgttgccgatatcgccacccagacatgagcgaggtgtccaacttgggggtgagcaaaaacgagttcatcttctgccatgacttccagaacaaggagtgtagccgcccaaattgccgtttcatccatggctccaaggaggatgaggatggctataagaagacaggagagcttcccccacggctgaggcagaaagtagcagctggccttggcctttcaccggctgacctaccaaatggcaaggaggaggtccctatctgccgtgactttctcaagggtgactgtcagagaggagccaagtgcaagttccgtcacctgcaacgggattttgagtttgatgctcggggtggaggaggcactggtgggggctcaacaggctcagtcctcccaggacgacgtcatgatctctatgatatctatgaccttcctgacaggggctttgaggaccatgagccaggcccaaaacgccggcgaggtggatgctgcccccctgatggccctcattttgagtcatatgaatatagtttggctccaccgcgaggggtggagtgcagactgctagaggaggagaatgccatgctcaggaagcgggtagaggagttaaagaagcaggtcagcaacctgctggccaccaatgaggtactactggaacaaaatgctcagttccgcaatcaggccaaggtcataaccctgagctccactgcaccagcgactgagcagactctggcccccactgtgggcactgttgccacttttaaccatggcattgcccagactcacactactctcagcagccaggctctacagcctcgtccagtgtcccagcaagaactggtggcccctgctggagctccagctgctcccccaactaatgctgcacctcctgctgctccaccacccccacccccacacttgaccccagagatcacgccactgtcagctgccctggctcaaacaattgcccagggaatggcacctccacctgtctccatggctcctgtggctgtatctgtggctcctgtggcccctgtggctgtatcgatggcccaacccttggcaggaatcacaatgagccacaccaccactcccatggtgacttaccctatcgcttcccagagcatgcgcatcacggccatgccacactgatggggctaatggacactcccctggtatagcctcgcagggctggggtcagggggcccttgcccactcacctagccttccccatccctgtctgaagggctcccttgagaactaggacaagagactacaaggagtatgtcctgaggaggggttgggatggtgtgttttctctcacctcccttttatgagggtcctcttgtccatcttcaagcctcacagtgggggcttgcagaggagtgcagactgaagccagcagagaggaaggactgactgaggggctgtgtcctcttatgggaatttgggaacatccctcgtcttgtcctctcttctgcacagcacaggttccagcactggttttagaagaaaaaaataccctgcccagagggaaagccaggaaagattgggaagtgggtggtcaggagagaaggcctgataggagccttcagacaatttgggtcctagttgcttgggttggacaatacaggaattgcttctgggccctgggaaagctgggaccatagtgctccagcccaaagactaggggagcattcattaccctagtttgacctgaaaatccatagggcagggcccactactttccaaagaaataaaagaacaattatttttaacaaatggaggcagtgaaaacttgcttagctattctgtgtggaagatgggagcagtaaatagatctcatgccaaaatgggataaagaccccagcctcacatagctttggtaagatggatagaagccagtgaagaagggtagggacccagaacaagaccaaatggggctttggggaaggcactttatggggtaaaagctttggagccacccagtctagttttaaaaatagtcccatctgtttctggtctctgtctgtattgtgctattcccaggttgcctcagtaaccaggctcctagggtcatttagcagggcaggcagtaaggagagtgtatttgctgaaatgcggatgggatgttacatagttgacagatccttattcaaacagagcaggacaggtggagttgatggccattgagttgatggcagttgccgctcagttgatggcagttaatgtccctcctaccccaccccttcagtggccagttcctgaagccttcaaggcttgggaggtctgggaaaagagagtccttctagggacacaagcctcagggtccatccctttcctctgtctccacataggaccagaagttttaaatctacttaagtcagtaaggccaggggccccaatagtcaaacctcagttcctcctcagctcacggctgatgtagggaaaacaactcaggtgtctagtctaatgggacagtagatttgggggtagagagtgatcctggattgtgttccccctcatcatgtctcctgctacctcttgctttcttgtctggttgatcactcaggtcacatctgggattggagatggtgggctaggtcaaggccagtcattaaaaaaaaaagcctaaagactaa

SEQ ID NO: 286181 - DNA, 3667 bp, Homo sapiens
gagacttaggtggaggccgcgcccggaggggaggagtcggggccggcccagcggctgggctcggccaggccacagaaggccccccagaaccgagctggctcgtcctcacaccccagggcagtgccccttttctgagtgaccccgcatcgcgagcaaacgccagcttcgtgacgtcacaaccctgcccatcccctcagcttgatgacacctggagctccagctccccgcttcacttcgcgcgcccttagtgtcccattcacgtagcccacggctgagcgccggcggcactgcacggaacctgccaagctagaagacttgctgcgggaaaactcctaggacttctttcgcaaactctagggtgttgggaagcgtcacaatcactgccttcaagtctaatcggccatcccaatgcactgtcagacgctgcctttttgaggttcctcactagccattactaactccagcccttggcggtgctctgaccctcacatcctctttcatcttgaggcagggcgccccgcactctttgttcactcagggctggttttccaacccctcctcccagtccctccgaattagttttactcttcttactggcaacttctcccttggacaggtgaagttcagtttgaaccctgaggaaatcctcacgttctcgaagctttgccgttttgtcagatttcttgtgacaaccaccccatagtcctccactcttactccttcttccacccaagtctctgtttttttcctgctcagaacccagcagtgatgtggaggtggagacccacaggagccccggacttcacctgagctacctcagtggtcaccaagagtggcaagataaagaaaaccctgagttgggcgggaccaggatgcctgaccgggacagctatgccaacggtaccgggagcagcggtggaggccctggaggtggtggcagcgaggaggccagtggggcaggggtaggcagtggcggggccagctcagatgccatctgtagagacttcttgaggaatgtgtgcaagcgaggcaagcgttgccgatatcgccacccagacatgagcgaggtgtccaacttgggggtgagcaaaaacgagttcatcttctgccatgacttccagaacaaggagtgtagccgcccaaattgccgtttcatccatggctccaaggaggatgaggatggctataagaagacaggagagcttcccccacggctgaggcagaaagtagcagctggccttggcctttcaccggctgacctaccaaatggcaaggaggaggtccctatctgccgtgactttctcaagggtgactgtcagagaggagccaagtgcaagttccgtcacctgcaacgggattttgagtttgatgctcggggtggaggaggcactggtgggggctcaacaggctcagtcctcccaggacgacgtcatgatctctatgatatctatgaccttcctgacaggggctttgaggaccatgagccaggcccaaaacgccggcgaggtggatgctgcccccctgatggccctcattttgagtcatatgaatatagtttggctccaccgcgaggggtggagtgcagactgctagaggaggagaatgccatgctcaggaagcgggtagaggagttaaagaagcaggtcagcaacctgctggccaccaatgaggtactactggaacaaaatgctcagttccgcaatcaggccaaggtcataaccctgagctccactgcaccagcgactgagcagactctggcccccactgtgggcactgttgccacttttaaccatggcattgcccagactcacactactctcagcagccaggctctacagcctcgtccagtgtcccagcaagaactggtggcccctgctggagctccagctgctcccccaactaatgctgcacctcctgctgctccaccacccccacccccacacttgaccccagagatcacgccactgtcagctgccctggctcaaacaattgcccagggaatggcacctccacctgtctccatggctcctgtggctgtatctgtggctcctgtggcccctgtggctgtatcgatggcccaacccttggcaggaatcacaatgagccacaccaccactcccatggtgacttaccctatcgcttcccagagcatgcgcatcacggccatgccacactgatggggctaatggacactcccctggtatagcctcgcagggctggggtcagggggcccttgcccactcacctagccttccccatccctgtctgaagggctcccttgagaactaggacaagagactacaaggagtatgtcctgaggaggggttgggatggtgtgttttctctcacctcccttttatgagggtcctcttgtccatcttcaagcctcacagtgggggcttgcagaggagtgcagactgaagccagcagagaggaaggactgactgaggggctgtgtcctcttatgggaatttgggaacatccctcgtcttgtcctctcttctgcacagcacaggttccagcactggttttagaagaaaaaaataccctgcccagagggaaagccaggaaagattgggaagtgggtggtcaggagagaaggcctgataggagccttcagacaatttgggtcctagttgcttgggttggacaatacaggaattgcttctgggccctgggaaagctgggaccatagtgctccagcccaaagactaggggagcattcattaccctagtttgacctgaaaatccatagggcagggcccactactttccaaagaaataaaagaacaattatttttaacaaatggaggcagtgaaaacttgcttagctattctgtgtggaagatgggagcagtaaatagatctcatgccaaaatgggataaagaccccagcctcacatagctttggtaagatggatagaagccagtgaagaagggtagggacccagaacaagaccaaatggggctttggggaaggcactttatggggtaaaagctttggagccacccagtctagttttaaaaatagtcccatctgtttctggtctctgtctgtattgtgctattcccaggttgcctcagtaaccaggctcctagggtcatttagcagggcaggcagtaaggagagtgtatttgctgaaatgcggatgggatgttacatagttgacagatccttattcaaacagagcaggacaggtggagttgatggccattgagttgatggcagttgccgctcagttgatggcagttaatgtccctcctaccccaccccttcagtggccagttcctgaagccttcaaggcttgggaggtctgggaaaagagagtccttctagggacacaagcctcagggtccatccctttcctctgtctccacataggaccagaagttttaaatctacttaagtcagtaaggccaggggccccaatagtcaaacctcagttcctcctcagctcacggctgatgtagggaaaacaactcaggtgtctagtctaatgggacagtagatttgggggtagagagtgatcctggattgtgttccccctcatcatgtctcctgctacctcttgctttcttgtctggttgatcactcaggtcacatctgggattggagatggtgggctaggtcaaggccagtcattaaaaaaaaaagcctaaagactaa

SEQ ID NO: 286182 - DNA, 2436 bp, Homo sapiens
ggaagcggaagagcgatcgggtaggcggctctttgtcgaagctagaggaccggcaggcggcagcagcaactacggcggcggcggcagaacccagcagtgatgtggaggtggagacccacaggagccccggacttcacctgagctacctcagtggtcaccaagagtggcaagataaagaaaaccctgagttgggcgggaccaggatgcctgaccgggacagctatgccaacggtaccgggagcagcggtggaggccctggaggtggtggcagcgaggaggccagtggggcaggggtaggcagtggcggggccagctcagatgccatctgtagagacttcttgaggaatgttgcagactgctagaggaggagaatgccatgctcaggaagcgggtagaggagttaaagaagcaggtcagcaacctgctggccaccaatgaggtactactggaacaaaatgctcagttccgcaatcaggccaaggtcataaccctgagctccactgcaccagcgactgagcagactctggcccccactgtgggcactgttgccacttttaaccatggcattgcccagactcacactactctcagcagccaggctctacagcctcgtccagtgtcccagcaagaactggtggcccctgctggagctccagctgctcccccaactaatgctgcacctcctgctgctccaccacccccacccccacacttgaccccagagatcacgccactgtcagctgccctggctcaaacaattgcccagggaatggcacctccacctgtctccatggctcctgtggctgtatctgtggctcctgtggcccctgtggctgtatcgatggcccaacccttggcaggaatcacaatgagccacaccaccactcccatggtgacttaccctatcgcttcccagagcatgcgcatcacggccatgccacactgatggggctaatggacactcccctggtatagcctcgcagggctggggtcagggggcccttgcccactcacctagccttccccatccctgtctgaagggctcccttgagaactaggacaagagactacaaggagtatgtcctgaggaggggttgggatggtgtgttttctctcacctcccttttatgagggtcctcttgtccatcttcaagcctcacagtgggggcttgcagaggagtgcagactgaagccagcagagaggaaggactgactgaggggctgtgtcctcttatgggaatttgggaacatccctcgtcttgtcctctcttctgcacagcacaggttccagcactggttttagaagaaaaaaataccctgcccagagggaaagccaggaaagattgggaagtgggtggtcaggagagaaggcctgataggagccttcagacaatttgggtcctagttgcttgggttggacaatacaggaattgcttctgggccctgggaaagctgggaccatagtgctccagcccaaagactaggggagcattcattaccctagtttgacctgaaaatccatagggcagggcccactactttccaaagaaataaaagaacaattatttttaacaaatggaggcagtgaaaacttgcttagctattctgtgtggaagatgggagcagtaaatagatctcatgccaaaatgggataaagaccccagcctcacatagctttggtaagatggatagaagccagtgaagaagggtagggacccagaacaagaccaaatggggctttggggaaggcactttatggggtaaaagctttggagccacccagtctagttttaaaaatagtcccatctgtttctggtctctgtctgtattgtgctattcccaggttgcctcagtaaccaggctcctagggtcatttagcagggcaggcagtaaggagagtgtatttgctgaaatgcggatgggatgttacatagttgacagatccttattcaaacagagcaggacaggtggagttgatggccattgagttgatggcagttgccgctcagttgatggcagttaatgtccctcctaccccaccccttcagtggccagttcctgaagccttcaaggcttgggaggtctgggaaaagagagtccttctagggacacaagcctcagggtccatccctttcctctgtctccacataggaccagaagttttaaatctacttaagtcagtaaggccaggggccccaatagtcaaacctcagttcctcctcagctcacggctgatgtagggaaaacaactcaggtgtctagtctaatgggacagtagatttgggggtagagagtgatcctggattgtgttccccctcatcatgtctcctgctacctcttgctttcttgtctggttgatcactcaggtcacatctgggattggagatggtgggctaggtcaaggccagtcattaaaaaaaaaagcctaaagactaa

SEQ ID NO: 286183 - DNA, 1137 bp, Homo sapiens
ggaagcggaagagcgatcgggtaggcggctctttgtcgaagctagaggaccggcaggcggcagcagcaactacggcggcggcggcagaacccagcagtgatgtggaggtggagacccacaggagccccggacttcacctgagctacctcagtggtcaccaagagtggcaagataaagaaaaccctgagttgggcgggaccaggatgcctgaccgggacagctatgccaacggtaccgggagcagcggtggaggccctggaggtggtggcagcgaggaggccagtggggcaggggtaggcagtggcggggccagctcagatgccatctgtagagacttcttgaggaatgtgtgcaagcgaggcaagcgttgccgatatcgccacccagacatgagcgaggtgtccaacttgggggtgagcaaaaacgagttcatcttctgccatgacttccagaacaaggagtgtagccgcccaaattgccgtttcatccatggctccaaggaggatgaggatggctataagaagacaggagagcttcccccacggctgaggcagaaagtagcagctggccttggcctttcaccggctgacctaccaaatggcaaggaggaggtccctatctgccgtgactttctcaagggtgactgtcagagaggagccaagtgcaagttccgtcacctgcaacgggattttgagtttgatgctcggggtggaggaggcactggtgggggctcaacaggctcagtcctcccaggacgacgtcatgatctctatgatatctatgaccttcctgacaggggctttgaggaccatgagccaggcccaaaacgccggcgaggtggatgctgcccccctgatggccctcattttgagtcatatgaatatagtttggctccaccgcgaggggtggagtgcagactgctagaggaggagaatgccatgctcaggaagcgggtagaggagttaaagaagcaggtcagcaacctgctggccaccaatgaggtactactggaacaaaatgctcagttccgcaatcaggccaaggtcataaccctgagctccactgcaccagcgactgagcagactctggcccccactgtgggcagcatccacctcgagctggtgtgccaaccccgag

SEQ ID NO: 286184 - DNA, 7340 bp, Homo sapiens
aagatttgggggtcgccttgccggcctcctgtcctcctccggcggcggcggagcccgagagaactaggtgaacaccgctttgccagcctcacacagcgtcccctggctctgccgccgctccggacgtcgccctcccgttctgcttgggtccccttagtcgctacctttgctgggatccccctcctccatcctgtggcttcgggttgccgaagagcgatgctcggagggcggccggaagtggcgttggccgccattggcctgccggccagccaccttgctgtcctccgccgccttccgggtgttacatgcagccgggctcggcccctccccctggccggatggatccgtcggcgccacagccccgcgcggaaacctcaggcaaagacatatggcatccaggagaaagatgtcttgccccttctccagataatggaaaactttgtgaagcaagcataaaatctatcacagtggatgaaaatggcaagtcatttgcagtcgtcttatatgcagattttcaagaaaggaaaatacctcttaaacagcttcaagaagtgaaatttgttaaagattgccctaggaatcttatatttgatgatgaagatttagaaaaaccttatttcccaaaccgaaaatttccatcatcttctgttgcttttaaattatctgacaatggagactctattccttataccatcaataggtatttgagagactaccaaagagaaggaacccggtttctttatggacactacatccatggaggagggtgcattctgggtgatgacatgggacttggaaaaacagtacaggttatttcatttctggctgcagttttgcataaaaagggaactcgtgaggatattgaaaataacatgccagagtttttactaagaagtatgaaaaaggaacccctttcttctacagcaaaaaagatgttcttaatagttgctcctctttctgtcctctacaactggaaggatgaattggacacctggggatatttcagagtcactgttttacatggaaacagaaaagataatgaattaattcgtgtaaagcagaggaaatgtgaaattgctctaacaacttatgaaacactacgcttatgcctggatgaacttaacagtttggaatggtcagctgtcattgtggatgaagctcatagaatcaagaatccaaaagctagagtaacagaagttatgaaagctttgaaatgtaatgtccgcattggcctcactggaaccatccttcagaacaacatgaaggaactgtggtgtgttatggactgggctgtgccaggccttttagggagtgggacctacttcaagaagcagttttctgacccagtagaacatggtcagagacacacggcaacaaagagagaactagccactggccgaaaggccatgcaaagacttgccaaaaagatgtctggctggtttctcaggcgcaccaagactcttatcaaggatcagttgcctaagaaggaagaccggatggtgtattgttctttgacagatttccagaaagctgtctatcaaacagtgttagaaacagaggacgtgactttgatacttcaatcttctgagccttgtacctgtaggagtggccaaaaaaggagaaattgttgttataagaccaattctcatggtgaaacagtgaaaaccttgtatctcagttaccttacagtccttcagaaggtagctaaccatgtcgcgctactgcaagctgctagtacttccaaacaacaggaaacacttatcaaaaggatatgtgatcaggtattttccagattcccagattttgtgcagaaaagcaaagatgcagcctttgaaacactttctgaccctaaatacagtggaaaaatgaaggtgagttcatctaaagtatatccttgattggccagcctcaacttttgaggcataaagaataaagcatatgcctacatgacaccttacagccacattttctcttatctacacagtaggaaatagtgagttgcttgacgtgctacagcagtactgtatggcgtctgggcttgattaccgacgacttgatggaagtacaaaatcagaggaaagactcaagattgtaaaagagttcaacagtacacaagatgttaacatttgccttgtctctacaatggctggtggactaggcctcaattttgtcggtgccaatgttgttgtattatttgatcctacttggaatccagccaatgatcttcaagccattgacagaacccaaacacattgtaggagagaaagggatgctgagcccctctcctctgctcctgggttgcagaatggaagtgagaatgcagtaccttacccctggtggtgctgtgtcacaggagcctccatttcctgctggagatgtgagatttgcaggatccaagatgtcctcgagtaaaagtccattgtgaggagggacagagcatataggattggacaatgtagagatgtcaaagtgcttaggctgatatccttgggaactgtggaggaaatcatgtatttacgacagatatacaagcagcaacttcactgtgtggtggttggaagtgaaaatgccaaacgatattttgaagcagttcaaggatctaaagagcatcaaggagagctttttgggatccataacctcttcaaatttaggtcccaagggtcttgtcttacgaaggacatcctggaggtgtgaacttcttctctgaccttttcaataatattttaaatacagtttttcttcctcaggaaatctgaaatacaattgctgttgccttttcagagaaacttttggttttctttatcaaaaatgccttggaatttttacttttagagaataagaaatgaattattgtacctctaaactaagattttcccatgcataattacaaataatgcacacacacaaatgtatatgctgggtagtatgaactccaaggcaattttaaataggcagagagaagtttatagttttgaaaacagctgctgaagtcaggaactaaaaaaagaggttttcctaaataaacaaaaatataaaatgtgttttaattaaaagttaccaaatactccctgagatgtactctcatgtctcatggagatttttgttttctgttcccaataaaaattccacaccagtattttaaactctccctgttgtgttcatcctcagcatacagatgtttcttattcctcaaacaaaatattttatatccttttttaaaaaaatctttaagttcttttatataccggaatactaaggatattaacctattttctaattgatattcatataggtatcataaaatcctggagtatcatctttttcaacctcctcatggtatagatgaggaaactgagtcttagagaacttcaggatatttctcttgacttccaggactttgtagtaaaatcttaatgtacttcatttattcagtaagtaccataaaggcagttcaaggagcaattggttcctgtccttgaggaacttaaaccatcttgaccggaggtggaagagaacgtttacataataaccatgcaatgtcaggaatcgtatgctgaacaagttaaacagtagaccatggatggctgggggagaggaagagagaaggccaagtagaagcagggatcatgacagccacaacatggttgaaagagggacctccagcacacaaactggaaatgcctagacagcctgactgtcaggaatgcagaggtacagaacaagctgcagagccactggcaaaggaagcatgtgatctctgcagtgacttcagtgatgaagagccagtgggagccacaggaataaagactgccaaaaacaaagcacccgattcaagtaaagcttccagctctccaggacagcttaccttactccagtgtggtttctcgaaattgcttgaaacaaaatgtaaagcagttgaggatagtgatggaaatactgcctctgatgatgaaagttctgatgagcagcccacatgcctttcaacagaagccaaagatgctggttgtgagaaaaatcaggactctcttggtacttcaaaacatcagaaattagataacatcctaaatccaaaagaaaagcatattttttataaaagtgagaagattttagaacagaatatttcttccaagtctgacgagaaaaaaattaaaaatacagataaacattgcattttacagaatgtcacagaatcagaagatagtgatgtcatctgtcctacacaatacacaactgagagattccccgacaatagtataaggtttaagccacccttggaaggatctgaggattctgaaacagaacacactgtaaaaacaagaaataatgataatagtcgaaacactgatgacaaaagaaatggaataatttcaaaaaagttaagtcctgagaacacaaccctgaaatctattttgaaaagaaaaggcaccagtgatatcagtgatgaatctgatgacattgaaatttcttccaagtcaagagtaagaaagagagctagttcattgaggtttaagagaataaaagaaaccaaaaaagaacttcacaattctcccaaaacaatgaacaaaacaaaccaagtgtatgcagcaaatgaggatcataactctcagtttattgatgattattcatcctcagatgagagtttatccgtcagccacttcagtttctctaaacagagccacagaccaagaactataagagacagaactagtttttcttcaaaattgcctagccataataagaaaaatagcacttttattccaagaaaaccaatgaaatgttcaaatgagaaagttgttaatcaagagcagtcgtatgaatcaatggataaatttttagatggcgttcaggaagtggcttatattcactcaaaccagaatgtaattggatcgagcaaagctgaaaatcacatgagccgatgggcagcacatgacgtatttgagttgaagcagttttctcagctgcctgctaacatagctgtttgcagttctaagaaaacaatttgaagaaatggcctcttattttaactcgtcttctgtaaacgaatttgctaaacatataaccaatgccacatcagaagaacgacagaaaatgctaagagacttttatgcttctcaatatccagaggtaaaagaattttttgtggattctgtgtcacaattcaacaattcttcctttgagaaaggagagcagcgcacccggaagaaatctgataaagagaatctcttataaaaccaaggctgtcagattctgaaaccttgtcatttaaagattctaccaacaaaatttctcaagtttgcagcctaaaaacatataaaagaaaatcagttaagtttcagaatcatatttcctatagagaagaggtgttttttaatgatgcagaaactaagaaatcacctgttagttctactcaagagattgacagtgggaaaaacagccaggcatccgaagatactgtgacatcccgttctctgaacagtgagtctgaaacacgtgagagaaggttagaaaataccatgaaagaccaacaggacctcacaagaacgggcatttcaagaaaagaaccccttctcaaattggaaaacaaaaagatagaaaatccagtgctggaaaatacttctgtgataagcttacttggtgatacctctattcttgatgacctttttaaaagtcatgggaacagtcccacacaactgccaaagaaagttctttcagggcccatggaaaaagcaaaacagagaccaaaagatttctgggacatcttgaatgagcagaatgatgagagtcttagtaaactcacagacttggcagtaatagagactctgtgtgaaaaagcacctctagcagcaccctttaaaaggagagaagagccagcaacttctctttggaaatcaaatgagaaatttttatggaagaaatttagcccaagtgatacagatgaaaacgcaaccaatacacagagtaccacataagcatataaatgaattactgcaccagtaaactgctgccatcactgtttacggcactggattccacactgattctattatcttgaacacagttgttgacatatatttttattaaattattgctttaggattttttgaagtctaaagtattgtcatggatctgtttttcttgatattgatttgatctttcaagaatatgattgtatttatagtataaacctctgttatgaattagaaaagattctaggtttgttaataggagacctgggacatctttcttactatattacataatgatgtgacacttgccccggtgagcattgtttcccagtatgaaagatgaagagtctgtaccgaatcagcatgagtgtccttccagtttaaaaaagctttgcttcgctctcctaatggctcataggctgaatcatgtctgcccctcaaatcaggtgtataccaatgtgttttttactagcacttgggaaagttattaagtattttctttttccctgggcatcatgttctattattattttagaaaaaagtcataattggtactgaatatatggtatatataatattaaaatggtaattttgcaacagctcaaaattaaaaggttaatgttatacactttactatatgagctgtgattactaccattagccacagataccagtgcctcaactttttatgtacctattgtgatttaatgtaaataaaggtttgtatagtacttttgtagttcttaagtatgaagaaatgggtaaactttttattttgttagaaactgttatattttgagtgtaatatttatggtttatagcaaaatgaatgtgcttattgttgaatgcatgtatttagaagcctttactcagcccctgtgttctgtgctaggagcttgagctctacaggtaaggcagagctaccggtgaatgaaaggaaatcatgtcagtgaaaaatcatggtggaaagcccctggcatcacatgtgcatgctgtaggcaggacctgagctgcctccgctgcaggttcagatgcaccgctgcagctgtccttcagttagttcacagggctgcaagaggaggacacatccctccagaaaacagcctgagccgggaactggctgtgctaaagagcactgctatcaagttgaggagagagggcttccgtgtactcaggatgtagagtcattgctcagaagtgaacaaaaaatcaaaaacaaaagtcttctcaagggactgatcggccaagtatgcttttctttagagcaatgttttgccctagagaattgtaaaatttatgtcatgactcagtacatatgtgttcgtacatatatgattggaataaaatgtttatgaaatatttactcataaaaaa

SEQ ID NO: 286185 - DNA, 7522 bp, Homo sapiens
aagatttgggggtcgccttgccggcctcctgtcctcctccggcggcggcggagcccgagagaactaggtgaacaccgctttgccagcctcacacagcgtcccctggctctgccgccgctccggacgtcgccctcccgttctgcttgggtccccttagtcgctacctttgctgggatccccctcctccatcctgtggcttcgggttgccgaagagcgatgctcggagggcggccggaagtggcgttggccgccattggcctgccggccagccaccttgctgtcctccgccgccttccgggtgttacatgcagccgggctcggcccctccccctggccggatggatccgtcggcgccacagccccgcgcggaaacctcaggcaaagacatatggcatccaggagaaagatgtcttgccccttctccagataatggaaaactttgtgaagcaagcataaaatctatcacagtggatgaaaatggcaagtcatttgcagtcgtcttatatgcagattttcaagaaaggaaaatacctcttaaacagcttcaagaagtgaaatttgttaaagattgccctaggaatcttatatttgatgatgaagatttagaaaaaccttatttcccaaaccgaaaatttccatcatcttctgttgcttttaaattatctgacaatggagactctattccttataccatcaataggtatttgagagactaccaaagagaaggaacccggtttctttatggacactacatccatggaggagggtgcattctgggtgatgacatgggacttggaaaaacagtacaggttatttcatttctggctgcagttttgcataaaaagggaactcgtgaggatattgaaaataacatgccagagtttttactaagaagtatgaaaaaggaacccctttcttctacagcaaaaaagatgttcttaatagttgctcctctttctgtcctctacaactggaaggatgaattggacacctggggatatttcagagtcactgttttacatggaaacagaaaagataatgaattaattcgtgtaaagcagaggaaatgtgaaattgctctaacaacttatgaaacactacgcttatgcctggatgaacttaacagtttggaatggtcagctgtcattgtggatgaagctcatagaatcaagaatccaaaagctagagtaacagaagttatgaaagctttgaaatgtaatgtccgcattggcctcactggaaccatccttcagaacaacatgaaggaactgtggtgtgttatggactgggctgtgccaggccttttagggagtgggacctacttcaagaagcagttttctgacccagtagaacatggtcagagacacacggcaacaaagagagaactagccactggccgaaaggccatgcaaagacttgccaaaaagatgtctggctggtttctcaggcgcaccaagactcttatcaaggatcagttgcctaagaaggaagaccggatggtgtattgttctttgacagatttccagaaagctgtctatcaaacagtgttagaaacagaggacgtgactttgatacttcaatcttctgagccttgtacctgtaggagtggccaaaaaaggagaaattgttgttataagaccaattctcatggtgaaacagtgaaaaccttgtatctcagttaccttacagtccttcagaaggtagctaaccatgtcgcgctactgcaagctgctagtacttccaaacaacaggaaacacttatcaaaaggatatgtgatcaggtattttccagattcccagattttgtgcagaaaagcaaagatgcagcctttgaaacactttctgaccctaaatacagtggaaaaatgaaggtgagttcatctaaagtatatccttgattggccagcctcaacttttgaggcataaagaataaagcatatgcctacatgacaccttacagccacattttctcttatctacacagtaggaaatagtgagttgcttgacgtgctacagcagtactgtatggcgtctgggcttgattaccgacgacttgatggaagtacaaaatcagaggaaagactcaagattgtaaaagagttcaacagtacacaagatgttaacatttgccttgtctctacaatggctggtggactaggcctcaattttgtcggtgccaatgttgttgtattatttgatcctacttggaatccagccaatgatcttcaagccattgacagaacccaaacacattgtaggagagaaagggatgctgagcccctctcctctgctcctgggttgcagaatggaagtgagaatgcagtaccttacccctggtggtgctgtgtcacaggagcctccatttcctgctggagatgtgagatttgcaggatccaagatgtcctcgagtaaaagtccattgtgaggagggacagagcatataggattggacaatgtagagatgtcaaagtgcttaggctgatatccttgggaactgtggaggaaatcatgtatttacgacagatatacaagcagcaacttcactgtgtggtggttggaagtgaaaatgccaaacgatattttgaagcagttcaaggatctaaagagcatcaaggagagctttttgggatccataacctcttcaaatttaggtcccaagggtcttgtcttacgaaggacatcctggaggtgtgaacttcttctctgaccttttcaataatattttaaatacagtttttcttcctcaggaaatctgaaatacaattgctgttgccttttcagagaaacttttggttttctttatcaaaaatgccttggaatttttacttttagagaataagaaatgaattattgtacctctaaactaagattttcccatgcataattacaaataatgcacacacacaaatgtatatgctgggtagtatgaactccaaggcaattttaaataggcagagagaagtttatagttttgaaaacagctgctgaagtcaggaactaaaaaaagaggttttcctaaataaacaaaaatataaaatgtgttttaattaaaagttaccaaatactccctgagatgtactctcatgtctcatggagatttttgttttctgttcccaataaaaattccacaccagtattttaaactctccctgttgtgttcatcctcagcatacagatgtttcttattcctcaaacaaaatattttatatccttttttaaaaaaatctttaagttcttttatataccggaatactaaggatattaacctattttctaattgatattcatataggtatcataaaatcctggagtatcatctttttcaacctcctcatggtatagatgaggaaactgagtcttagagaacttcaggatatttctcttgacttccaggactttgtagtaaaatcttaatgtacttcatttattcagtaagtaccataaaggcagttcaaggagcaattggttcctgtccttgaggaacttaaaccatcttgaccggaggtggaagagaacgtttacataataaccatgcaatgtcaggaatcgtatgctgaacaagttaaacagtagaccatggatggctgggggagaggaagagagaaggccaagtagaagcagggatcatgacagccacaacatggttgaaagagggacctccagcacacaaactggaaatgcctagacagcctgactgtcaggaatgcagaggtacagaacaagctgcagagccactggcaaaggaagcatgtgatctctgcagtgacttcagtgatgaagagccagtgggagccacaggaataaagactgccaaaaacaaagcacccgattcaagtaaagcttccagctctccaggacagcttaccttactccagtgtggtttctcgaaattgcttgaaacaaaatgtaaagcagttgaggatagtgatggaaatactgcctctgatgatgaaagttctgatgagcagcccacatgcctttcaacagaagccaaagatgctggttgtgagaaaaatcaggactctcttggtacttcaaaacatcagaaattagataacatcctaaatccaaaagaaaagcatattttttataaaagtgagaagattttagaacagaatatttcttccaagtctgacgagaaaaaaattaaaaatacagataaacattgcattttacagaatgtcacagaatcagaagatagtgatgtcatctgtcctacacaatacacaactgagagattccccgacaatagtataaggtttaagccacccttggaaggatctgaggattctgaaacagaacacactgtaaaaacaagaaataatgataatagtcgaaacactgatgacaaaagaaatggaataatttcaaaaaagttaagtcctgagaacacaaccctgaaatctattttgaaaagaaaaggcaccagtgatatcagtgatgaatctgatgacattgaaatttcttccaagtcaagagtaagaaagagagctagttcattgaggtttaagagaataaaagaaaccaaaaaagaacttcacaattctcccaaaacaatgaacaaaacaaaccaagtgtatgcagcaaatgaggatcataactctcagtttattgatgattattcatcctcagatgagagtttatccgtcagccacttcagtttctctaaacagagccacagaccaagaactataagagacagaactagtttttcttcaaaattgcctagccataataagaaaaatagcacttttattccaagaaaaccaatgaaatgttcaaatgagaaagttgttaatcaagagcagtcgtatgaatcaatggataaatttttagatggcgttcaggaagtggcttatattcactcaaaccagaatgtaattggatcgagcaaagctgaaaatcacatgagccgatgggcagcacatgacgtatttgagttgaagcagttttctcagctgcctgctaacatagctgtttgcagttctaagacatataaagaaaaagtggatgcagatacattgccacacacaaagaaaggccagcaaccgagtgaaggcagcatttcacttcctctttacatttcaaatcctgtaaaccagaagaagaaaaaagtctaccatacaaaccagaccaccttcataattggagaaacaccaaaaggaatccgcagaaaacaatttgaagaaatggcctcttattttaactcgtcttctgtaaacgaatttgctaaacatataaccaatgccacatcagaagaacgacagaaaatgctaagagacttttatgcttctcaatatccagaggtaaaagaattttttgtggattctgtgtcacaattcaacaattcttcctttgagaaaggagagcagcgcacccggaagaaatctgataaagagaatctcttataaaaccaaggctgtcagattctgaaaccttgtcatttaaagattctaccaacaaaatttctcaagtttgcagcctaaaaacatataaaagaaaatcagttaagtttcagaatcatatttcctatagagaagaggtgttttttaatgatgcagaaactaagaaatcacctgttagttctactcaagagattgacagtgggaaaaacagccaggcatccgaagatactgtgacatcccgttctctgaacagtgagtctgaaacacgtgagagaaggttagaaaataccatgaaagaccaacaggacctcacaagaacgggcatttcaagaaaagaaccccttctcaaattggaaaacaaaaagatagaaaatccagtgctggaaaatacttctgtgataagcttacttggtgatacctctattcttgatgacctttttaaaagtcatgggaacagtcccacacaactgccaaagaaagttctttcagggcccatggaaaaagcaaaacagagaccaaaagatttctgggacatcttgaatgagcagaatgatgagagtcttagtaaactcacagacttggcagtaatagagactctgtgtgaaaaagcacctctagcagcaccctttaaaaggagagaagagccagcaacttctctttggaaatcaaatgagaaatttttatggaagaaatttagcccaagtgatacagatgaaaacgcaaccaatacacagagtaccacataagcatataaatgaattactgcaccagtaaactgctgccatcactgtttacggcactggattccacactgattctattatcttgaacacagttgttgacatatatttttattaaattattgctttaggattttttgaagtctaaagtattgtcatggatctgtttttcttgatattgatttgatctttcaagaatatgattgtatttatagtataaacctctgttatgaattagaaaagattctaggtttgttaataggagacctgggacatctttcttactatattacataatgatgtgacacttgccccggtgagcattgtttcccagtatgaaagatgaagagtctgtaccgaatcagcatgagtgtccttccagtttaaaaaagctttgcttcgctctcctaatggctcataggctgaatcatgtctgcccctcaaatcaggtgtataccaatgtgttttttactagcacttgggaaagttattaagtattttctttttccctgggcatcatgttctattattattttagaaaaaagtcataattggtactgaatatatggtatatataatattaaaatggtaattttgcaacagctcaaaattaaaaggttaatgttatacactttactatatgagctgtgattactaccattagccacagataccagtgcctcaactttttatgtacctattgtgatttaatgtaaataaaggtttgtatagtacttttgtagttcttaagtatgaagaaatgggtaaactttttattttgttagaaactgttatattttgagtgtaatatttatggtttatagcaaaatgaatgtgcttattgttgaatgcatgtatttagaagcctttactcagcccctgtgttctgtgctaggagcttgagctctacaggtaaggcagagctaccggtgaatgaaaggaaatcatgtcagtgaaaaatcatggtggaaagcccctggcatcacatgtgcatgctgtaggcaggacctgagctgcctccgctgcaggttcagatgcaccgctgcagctgtccttcagttagttcacagggctgcaagaggaggacacatccctccagaaaacagcctgagccgggaactggctgtgctaaagagcactgctatcaagttgaggagagagggcttccgtgtactcaggatgtagagtcattgctcagaagtgaacaaaaaatcaaaaacaaaagtcttctcaagggactgatcggccaagtatgcttttctttagagcaatgttttgccctagagaattgtaaaatttatgtcatgactcagtacatatgtgttcgtacatatatgattggaataaaatgtttatgaaatatttactcataaaaaa

SEQ ID NO: 286186 - DNA, 4582 bp, Homo sapiens
aagatttgggggtcgccttgccggcctcctgtcctcctccggcggcggcggagcccgagagaactaggtgaacaccgctttgccagcctcacacagcgtcccctggctctgccgccgctccggacgtcgccctcccgttctgcttgggtccccttagtcgctacctttgctgggatccccctcctccatcctgtggcttcgggttgccgaagagcgatgctcggagggcggccggaagtggcgttggccgccattggcctgccggccagccaccttgctgtcctccgccgccttccgggtgttacatgcagccgggctcggcccctccccctggccggatggatccgtcggcgccacagccccgcgcggaaacctcaggcaaagacatatggcatccaggagaaagatgtcttgccccttctccagataatggaaaactttgtgaagcaagcataaaatctatcacagtggatgaaaatggcaagtcatttgcagtcgtcttatatgcagattttcaagaaaggaaaatacctcttaaacagcttcaagaagtgaaatttgttaaagattgccctaggaatcttatatttgatgatgaagatttagaaaaaccttatttcccaaaccgaaaatttccatcatcttctgttgcttttaaattatctgacaatggagactctattccttataccatcaataggtatttgagagactaccaaagagaaggaacccggtttctttatggacactacatccatggaggagggtgcattctgggtgatgacatgggacttggaaaaacagtacaggttatttcatttctggctgcagttttgcataaaaagggaactcgtgaggatattgaaaataacatgccagagtttttactaagaagtatgaaaaaggaacccctttcttctacagcaaaaaagatgttcttaatagttgctcctctttctgtcctctacaactggaaggatgaattggacacctggggatatttcagagtcactgttttacatggaaacagaaaagataatgaattaattcgtgtaaagcagaggaaatgtgaaattgctctaacaacttatgaaacactacgcttatgcctggatgaacttaacagtttggaatggtcagctgtcattgtggatgaagctcatagaatcaagaatccaaaagctagagtaacagaagttatgaaagctttgaaatgtaatgtccgcattggcctcactggaaccatccttcagaacaacatgaaggaactgtggtgtgttatggactgggctgtgccaggccttttagggagtgggacctacttcaagaagcagttttctgacccagtagaacatggtcagagacacacggcaacaaagagagaactagccactggccgaaaggccatgcaaagacttgccaaaaagatgtctggctggtttctcaggcgcaccaagactcttatcaaggatcagttgcctaagaaggaagaccggatggtgtattgttctttgacagatttccagaaagctgtctatcaaacagtgttagaaacagaggacgtgactttgatacttcaatcttctgagccttgtacctgtaggagtggccaaaaaaggagaaattgttgttataagaccaattctcatggtgaaacagtgaaaaccttgtatctcagttaccttacagtccttcagaaggtagctaaccatgtcgcgctactgcaagctgctagtacttccaaacaacaggaaacacttatcaaaaggatatgtgatcaggtattttccagattcccagattttgtgcagaaaagcaaagatgcagcctttgaaacactttctgaccctaaatacagtggaaaaatgaaggtgagttcatctaaagtatatccttgattggccagcctcaacttttgaggcataaagaataaagcatatgcctacatgacaccttacagccacattttctcttatctacacagtaggaaatagtgagttgcttgacgtgctacagcagtactgtatggcgtctgggcttgattaccgacgacttgatggaagtacaaaatcagaggaaagactcaagattgtaaaagagttcaacagtacacaagatgttaacatttgccttgtctctacaatggctggtggactaggcctcaattttgtcggtgccaatgttgttgtattatttgatcctacttggaatccagccaatgatcttcaagccattgacagaacccaaacacattgtaggagagaaagggatgctgagcccctctcctctgctcctgggttgcagaatggaagtgagaatgcagtaccttacccctggtggtgctgtgtcacaggagcctccatttcctgctggagatgtgagatttgcaggatccaagatgtcctcgagtaaaagtccattgtgaggagggacagagcatataggattggacaatgtagagatgtcaaagtgcttaggctgatatccttgggaactgtggaggaaatcatgtatttacgacagatatacaagcagcaacttcactgtgtggtggttggaagtgaaaatgccaaacgatattttgaagcagttcaaggatctaaagagcatcaaggagagctttttgggatccataacctcttcaaatttaggtcccaagggtcttgtcttacgaaggacatcctggagtaagtaccataaaggcagttcaaggagcaattggttcctgtccttgaggaacttaaaccatcttgaccggaggtggaagagaacgtttacataataaccatgcaatgtcaggaatcgtatgctgaacaagttaaacagtagaccatggatggctgggggagaggaagagagaaggccaagtagaagcagggatcatgacagccacaacatggttgaaagagggacctccagcacacaaactggaaatgcctagacagcctgactgtcaggaatgcagaggtacagaacaagctgcagagccactggcaaaggaagcatgtgatctctgcagtgacttcagtgatgaagagccagtgggagccacaggaataaagactgccaaaaacaaagcacccgattcaagtaaagcttccagctctccaggacagcttaccttactccagtgtggtttctcgaaattgcttgaaacaaaatgtaaagcagttgaggatagtgatggaaatactgcctctgatgatgaaagttctgatgagcagcccacatgcctttcaacagaagccaaagatgctggttgtgagaaaaatcaggactctcttggtacttcaaaacatcagaaattagataacatcctaaatccaaaagaaaagcatattttttataaaagtgagaagattttagaacagaatatttcttccaagtctgacgagaaaaaaattaaaaatacagataaacattgcattttacagaatgtcacagaatcagaagatagtgatgtcatctgtcctacacaatacacaactgagagattccccgacaatagtataaggtttaagccacccttggaaggatctgaggattctgaaacagaacacactgtaaaaacaagaaataatgataatagtcgaaacactgatgacaaaagaaatggaataatttcaaaaaagttaagtcctgagaacacaaccctgaaatctattttgaaaagaaaaggcaccagtgatatcagtgatgaatctgatgacattgaaatttcttccaagtcaagagtaagaaagagagctagttcattgaggtttaagagaataaaagaaaccaaaaaagaacttcacaattctcccaaaacaatgaacaaaacaaaccaagtgtatgcagcaaatgaggatcataactctcagtttattgatgattattcatcctcagatgagagtttatccgtcagccacttcagtttctctaaacagagccacagaccaagaactataagagacagaactagtttttcttcaaaattgcctagccataataagaaaaatagcacttttattccaagaaaaccaatgaaatgttcaaatgagaaagttgttaatcaagagcagtcgtatgaatcaatggataaatttttagatggcgttcaggaagtggcttatattcactcaaaccagaatgtaattggatcgagcaaagctgaaaatcacatgagccgatgggcagcacatgacgtatttgagttgaagcagttttctcagctgcctgctaacatagctgtttgcagttctaagacatataaagaaaaagtggatgcagatacattgccacacacaaagaaaggccagcaaccgagtgaaggcagcatttcacttcctctttacatttcaaatcctgtaaaccagaagaagaaaaaagtctaccatacaaaccagaccaccttcataattggagaaacaccaaaaggaatccgcaggtatattgtctctgacaatactatacttgaagaataattctcaaaggaaatgtagctcattagtaaaatatgtaaatacttgaattataaccataactgacatctgaatatttcagaaaaatctgaatttcaaaaataaactgcaaatgtttt

SEQ ID NO: 286187 - DNA, 3080 bp, Homo sapiens
aagatttgggggtcgccttgccggcctcctgtcctcctccggcggcggcggagcccgagagaactaggtgaacaccgctttgccagcctcacacagcgtcccctggctctgccgccgctccggacgtcgccctcccgttctgcttgggtccccttagtcgctacctttgctgggatccccctcctccatcctgtggcttcgggttgccgaagagcgatgctcggagggcggccggaagtggcgttggccgccattggcctgccggccagccaccttgctgtcctccgccgccttccgggtgttacatgcagccgggctcggcccctccccctggccggatggatccgtcggcgccacagccccgcgcggaaacctcaggcaaagacatatggcatccaggagaaagatgtcttgccccttctccagataatggaaaactttgtgaagcaagcataaaatctatcacagtggatgaaaatggcaagtcatttgcagtcgtcttatatgcagattttcaagaaaggaaaatacctcttaaacagcttcaagaagtgaaatttgttaaagattgccctaggaatcttatatttgatgatgaagatttagaaaaaccttatttcccaaaccgaaaatttccatcatcttctgttgcttttaaattatctgacaatggagactctattccttataccatcaataggtatttgagagactaccaaagagaaggaacccggtttctttatggacactacatccatggaggagggtgcattctgggtgatgacatgggacttggaaaaacagtacaggttatttcatttctggctgcagttttgcataaaaagggaactcgtgaggatattgaaaataacatgccagagtttttactaagaagtatgaaaaaggaacccctttcttctacagcaaaaaagatgttcttaatagttgctcctctttctgtcctctacaactggaaggatgaattggacacctggggatatttcagagtcactgttttacatggaaacagaaaagataatgaattaattcgtgtaaagcagaggaaatgtgaaattgctctaacaacttatgaaacactacgcttatgcctggatgaacttaacagtttggaatggtcagctgtcattgtggatgaagctcatagaatcaagaatccaaaagctagagtaacagaagttatgaaagctttgaaatgtaatgtccgcattggcctcactggaaccatccttcagaacaacatgaaggaactgtggtgtgttatggactgggctgtgccaggccttttagggagtgggacctacttcaagaagcagttttctgacccagtagaacatggtcagagacacacggcaacaaagagagaactagccactggccgaaaggccatgcaaagacttgccaaaaagatgtctggctggtttctcaggcgcaccaagactcttatcaaggatcagttgcctaagaaggaagaccggatggtgtattgttctttgacagatttccagaaagctgtctatcaaacagtgttagaaacagaggacgtgactttgatacttcaatcttctgagccttgtacctgtaggagtggccaaaaaaggagaaattgttgttataagaccaattctcatggtgaaacagtgaaaaccttgtatctcagttaccttacagtccttcagaaggtagctaaccatgtcgcgctactgcaagctgctagtacttccaaacaacaggaaacacttatcaaaaggatatgtgatcaggtattttccagattcccagattttgtgcagaaaagcaaagatgcagcctttgaaacactttctgaccctaaatacagtggaaaaatgaaggtccttcagcagcttttaaatcattgcaggaaaaacagagataaagttcttctcttttctttttccaccaagttgcttgacgtgctacagcagtactgtatggcgtctgggcttgattaccgacgacttgatggaagtacaaaatcagaggaaagactcaagattgtaaaagagttcaacagtacacaagatgttaacatttgccttgtctctacaatggctggtggactaggcctcaattttgtcggtgccaatgttgttgtattatttgatcctacttggaatccagccaatgatcttcaagccattgacagaacccaaacacattgtaggagagaaagggatgctgagcccctctcctctgctcctgggttgcagaatggaagtgagaatgcagtaccttacccctggtggtgctgtgtcacaggagcctccatttcctgctggagatgtgagatttgcaggatccaagatgtcctcgagtaaaagtccattgtgaggagggacagagcatataggattggacaatgtagagatgtcaaagtgcttaggctgatatccttgggaactgtggaggaaatcatgtatttacgacagatatacaagcagcaacttcactgtgtggtggttggaagtgaaaatgccaaacgatattttgaagcagttcaaggatctaaagagcatcaaggagagctttttgggatccataacctcttcaaatttaggtcccaagggtcttgtcttacgaaggacatcctggaggtgtgaacttcttctctgaccttttcaataatattttaaatacagtttttcttcctcaggaaatctgaaatacaattgctgttgccttttcagagaaacttttggttttctttatcaaaaatgccttggaatttttacttttagagaataagaaatgaattattgtacctctaaactaagattttcccatgcataattacaaataatgcacacacacaaatgtatatgctgggtagtatgaactccaaggcaattttaaataggcagagagaagtttatagttttgaaaacagctgctgaagtcaggaactaaaaaaagaggttttcctaaataaacaaaaatataaaatgtgttttaattaaaagttaccaaatactccctgagatgtactctcatgtctcatggagatttttgttttctgttcccaataaaaattccacaccagt

SEQ ID NO: 286188 - DNA, 5714 bp, Homo sapiens
aagatttgggggtcgccttgccggcctcctgtcctcctccggcggcggcggagcccgagagaactaggtgaacaccgctttgccagcctcacacagcgtcccctggctctgccgccgctccggacgtcgccctcccgttctgcttgggtccccttagtcgctacctttgctgggatccccctcctccatcctgtggcttcgggttgccgaagagcgatgctcggagggcggccggaagtggcgttggccgccattggcctgccggccagccaccttgctgtcctccgccgccttccgggtgttacatgcagccgggctcggcccctccccctggccggatggatccgtcggcgccacagccccgcgcggaaacctcaggcaaagacatatggcatccaggagaaagatgtcttgccccttctccagataatggaaaactttgtgaagcaagcataaaatctatcacagtggatgaaaatggcaagtcatttgcagtcgtcttatatgcagattttcaagaaaggaaaatacctcttaaacagcttcaagaagtgaaatttgttaaagattgccctaggaatcttatatttgatgatgaagatttagaaaaaccttatttcccaaaccgaaaatttccatcatcttctgttgcttttaaattatctgacaatggagactctattccttataccatcaataggtatttgagagactaccaaagagaaggaacccggtttctttatggacactacatccatggaggagggtgcattctgggtgatgacatgggacttggaaaaacagtacaggttatttcatttctggctgcagttttgcataaaaagggaactcgtgaggatattgaaaataacatgccagagtttttactaagaagtatgaaaaaggaacccctttcttctacagcaaaaaagatgttcttaatagttgctcctctttctgtcctctacaactggaaggatgaattggacacctggggatatttcagagtcactgttttacatggaaacagaaaagataatgaattaattcgtgtaaagcagaggaaatgtgaaattgctctaacaacttatgaaacactacgcttatgcctggatgaacttaacagtttggaatggtcagctgtcattgtggatgaagctcatagaatcaagaatccaaaagctagagtaacagaagttatgaaagctttgaaatgtaatgtccgcattggcctcactggaaccatccttcagaacaacatgaaggaactgtggtgtgttatggactgggctgtgccaggccttttagggagtgggacctacttcaagaagcagttttctgacccagtagaacatggtcagagacacacggcaacaaagagagaactagccactggccgaaaggccatgcaaagacttgccaaaaagatgtctggctggtttctcaggcgcaccaagactcttatcaaggatcagttgcctaagaaggaagaccggatggtgtattgttctttgacagatttccagaaagctgtctatcaaacagtgttagaaacagaggacgtgactttgatacttcaatcttctgagccttgtacctgtaggagtggccaaaaaaggagaaattgttgttataagaccaattctcatggtgaaacagtgaaaaccttgtatctcagttaccttacagtccttcagaaggtagctaaccatgtcgcgctactgcaagctgctagtacttccaaacaacaggaaacacttatcaaaaggatatgtgatcaggtattttccagattcccagattttgtgcagaaaagcaaagatgcagcctttgaaacactttctgaccctaaatacagtggaaaaatgaaggtgagttcatctaaagtatatccttgattggccagcctcaacttttgaggcataaagaataaagcatatgcctacatgacaccttacagccacattttctcttatctacacagtaggaaatagtgagttgcttgacgtgctacagcagtactgtatggcgtctgggcttgattaccgacgacttgatggaagtacaaaatcagaggaaagactcaagattgtaaaagagttcaacagtacacaagatgttaacatttgccttgtctctacaatggctggtggactaggcctcaattttgtcggtgccaatgttgttgtattatttgatcctacttggaatccagccaatgatcttcaagccattgacagaacccaaacacattgtaggagagaaagggatgctgagcccctctcctctgctcctgggttgcagaatggaagtgagaatgcagtaccttacccctggtggtgctgtgtcacaggagcctccatttcctgctggagatgtgagatttgcaggatccaagatgtcctcgagtaaaagtccattgtgaggagggacagagcatataggattggacaatgtagagatgtcaaagtgcttaggctgatatccttgggaactgtggaggaaatcatgtatttacgacagatatacaagcagcaacttcactgtgtggtggttggaagtgaaaatgccaaacgatattttgaagcagttcaaggatctaaagagcatcaaggagagctttttgggatccataacctcttcaaatttaggtcccaagggtcttgtcttacgaaggacatcctggaggtgtgaacttcttctctgaccttttcaataatattttaaatacagtttttcttcctcaggaaatctgaaatacaattgctgttgccttttcagagaaacttttggttttctttatcaaaaatgccttggaatttttacttttagagaataagaaatgaattattgtacctctaaactaagattttcccatgcataattacaaataatgcacacacacaaatgtatatgctgggtagtatgaactccaaggcaattttaaataggcagagagaagtttatagttttgaaaacagctgctgaagtcaggaactaaaaaaagaggttttcctaaataaacaaaaatataaaatgtgttttaattaaaagttaccaaatactccctgagatgtactctcatgtctcatggagatttttgttttctgttcccaataaaaattccacaccagtattttaaactctccctgttgtgttcatcctcagcatacagatgtttcttattcctcaaacaaaatattttatatccttttttaaaaaaatctttaagttcttttatataccggaatactaaggatattaacctattttctaattgatattcatataggtatcataaaatcctggagtatcatctttttcaacctcctcatggtatagatgaggaaactgagtcttagagaacttcaggatatttctcttgacttccaggactttgtagtaaaatcttaatgtacttcatttattcagtaagtaccataaaggcagttcaaggagcaattggttcctgtccttgaggaacttaaaccatcttgaccggaggtggaagagaacgtttacataataaccatgcaatgtcaggaatcgtatgctgaacaagttaaacagtagaccatggatggctgggggagaggaagagagaaggccaagtagaagcagggatcatgacagccacaacatggttgaaagagggacctccagcacacaaactggaaatgcctagacagcctgactgtcaggaatgcagaggtacagaacaagctgcagagccactggcaaaggaagcatgtgatctctgcagtgacttcagtgatgaagagccagtgggagccacaggaataaagactgccaaaaacaaagcacccgattcaagtaaagcttccagctctccaggacagcttaccttactccagtgtggtttctcgaaattgcttgaaacaaaatgtaaagcagttgaggatagtgatggaaatactgcctctgatgatgaaagttctgatgagcagcccacatgcctttcaacagaagccaaagatgctggttgtgagaaaaatcaggactctcttggtacttcaaaacatcagaaattagataacatcctaaatccaaaagaaaagcatattttttataaaagtgagaagattttagaacagaatatttcttccaagtctgacgagaaaaaaattaaaaatacagataaacattgcattttacagaatgtcacagaatcagaagatagtgatgtcatctgtcctacacaatacacaactgagagattccccgacaatagtataaggtttaagccacccttggaaggatctgaggattctgaaacagaacacactgtaaaaacaagaaataatgataatagtcgaaacactgatgacaaaagaaatggaataatttcaaaaaagttaagtcctgagaacacaaccctgaaatctattttgaaaagaaaaggcaccagtgatatcagtgatgaatctgatgacattgaaatttcttccaagtcaagagtaagaaagagagctagttcattgaggtttaagagaataaaagaaaccaaaaaagaacttcacaattctcccaaaacaatgaacaaaacaaaccaagtgtatgcagcaaatgaggatcataactctcagtttattgatgattattcatcctcagatgagagtttatccgtcagccacttcagtttctctaaacagagccacagaccaagaactataagagacagaactagtttttcttcaaaattgcctagccataataagaaaaatagcacttttattccaagaaaaccaatgaaatgttcaaatgagaaagttgttaatcaagagcagtcgtatgaatcaatggataaatttttagatggcgttcaggaagtggcttatattcactcaaaccagaatgtaattggatcgagcaaagctgaaaatcacatgagccgatgggcagcacatgacgtatttgagttgaagcagttttctcagctgcctgctaacatagctgtttgcagttctaagacatataaagaaaaagtggatgcagatacattgccacacacaaagaaaggccagcaaccgagtgaaggcagcatttcacttcctctttacatttcaaatcctgtaaaccagaagaagaaaaaagtctaccatacaaaccagaccaccttcataattggagaaacaccaaaaggaatccgcaggtatattgtctctgacaatactatacttgaagaataattctcaaaggaaatgtagctcattagtaaaatatgtaaatacttgaattataaccataactgacatctgaatatttcagaaaaatctgaatttcaaaaataaactgcaaatgttttagatgttgttagaaggctaatccctgaattgattaccataaaaagggaaatcatgttatacaaagaaatgaaatacttaagtgcattttattcattcagtcaatgaatatattttgagcacctaatatatgcccaggcattgtgctgagtcttgaatatgcagtgtaaaaaaaggacagcagggtgcggtggctcatgcttgtaatctcagcactttgggaggccgaggcgggtggatcacgaggtcaggagattgagaccatcctggctaatacggtgaaaccccgtctctactaaaaatgcaaaaaattagccgggcgtggtggcgggcacctgtagtcccagctactcaggaggctgaggcaggagaatggagtgaacctgggag

SEQ ID NO: 286189 - DNA, 2209 bp, Homo sapiens
aagatttgggggtcgccttgccggcctcctgtcctcctccggcggcggcggagcccgagagaactaggtgaacaccgctttgccagcctcacacagcgtcccctggctctgccgccgctccggacgtcgccctcccgttctgcttgggtccccttagtcgctacctttgctgggatccccctcctccatcctgtggcttcgggttgccgaagagcgatgctcggagggcggccggaagtggcgttggccgccattggcctgccggccagccaccttgctgtcctccgccgccttccgggtgttacatgcagccgggctcggcccctccccctggccggatggatccgtcggcgccacagccccgcgcggaaacctcaggcaaagacatatggcatccaggagaaagatgtcttgccccttctccagataatggaaaactttgtgaagcaagcataaaatctatcacagtggatgaaaatggcaagtcatttgcagtcgtcttatatgcagattttcaagaaaggaaaatacctcttaaacagcttcaagaagtgaaatttgttaaagattgccctaggaatcttatatttgatgatgaagatttagaaaaaccttatttcccaaaccgaaaatttccatcatcttctgttgcttttaaattatctgacaatggagactctattccttataccatcaataggtatttgagagactaccaaagagaaggaacccggtttctttatggacactacatccatggaggagggtgcattctgggtgatgacatgggacttggaaaaacagtacaggttatttcatttctggctgcagttttgcataaaaagggaactcgtgaggatattgaaaataacatgccagagtttttactaagaagtatgaaaaaggaacccctttcttctacagcaaaaaagatgttcttaatagttgctcctctttctgtcctctacaactggaaggatgaattggacacctggggatatttcagagtcactgttttacatggaaacagaaaagataatgaattaattcgtgtaaagcagaggaaatgtgaaattgctctaacaacttatgaaacactacgcttatgcctggatgaacttaacagtttggaatggtcagctgtcattgtggatgaagctcatagaatcaagaatccaaaagctagagtaacagaagttatgaaagctttgaaatgtaatgtccgcattggcctcactggaaccatccttcagaacaacatgaaggaactgtggtgtgttatggactgggctgtgccaggccttttagggagtgggacctacttcaagaagcagttttctgacccagtagaacatggtcagagacacacggcaacaaagagagaactagccactggccgaaaggccatgcaaagacttgccaaaaagatgtctggctggtttctcaggcgcaccaagactcttatcaaggatcagttgcctaagaaggaagaccggatggtgtattgttctttgacagatttccagaaagctgtctatcaaacagtgttagaaacagaggacgtgactttgatacttcaatcttctgagccttgtacctgtaggagtggccaaaaaaggagaaattgttgttataagaccaattctcatggtgaaacagtgaaaaccttgtatctcagttaccttacagtccttcagaaggtagctaaccatgtcgcgctactgcaagctgctagtacttccaaacaacaggaaacacttatcaaaaggatatgtgatcaggtattttccagattcccagattttgtgcagaaaagcaaagatgcagcctttgaaacactttctgaccctaaatacagtggaaaaatgaaggtccttcagcagcttttaaatcattgcaggaaaaacagagataaagttcttctcttttctttttccaccaagttgcttgacgtgctacagcagtactgtatggcgtctgggcttgattaccgacgacttgatggaagtacaaaatcagaggaaagactcaagattgtaaaagagttcaacagtacacaagatgttaacatttgccttgtctctacaattagagacggggtttcaccgttttagccgggatggtctcgatctcctgacctcgtgatccgcccgcctcggcctcccaaagtgctgggattacaggcgtgagccactgcgcccggccccat

SEQ ID NO: 286190 - DNA, 386 bp, Homo sapiens
ctgttgcttttaaattatctgacaatggagactctattccttataccatcaataggtatttgagagactaccaaagagaaggaacccggtttctttatggacactacatccatggaggagggtgcattctgggtgatgacatgggacttggaaaaacagtacaggtatttaattatgttataacagtaaagtcactttactgtgtacatgagtggatactatatgtaaatctttatttgtactgctgttacgatagctattttgtgtgttcctgtgtatgtttgtgtttgtctcactaactagatagtgaagtcctcaaagttgaggacaatgtctcagttattttatcattcttcagtacctatgaaatattttattccaaaata

SEQ ID NO: 286191 - DNA, 1059 bp, Homo sapiens
atttaaatttctgtaccagtaggaagatgcatagagtattaggataacgatgctggaggtgttctgccgtaacggaaacacagaaaggcagccgctgaaagggcatgtgtgggtaattagttctcactatggttagactcctgaagtgagtggtccaagttgttagcgtgcttctgctctgtgaggccaggccagtatcctgtctgcatggctgaagacgaatcactgatatacactcaataacagaaaccttggccgaattgtcacaatagcagagccattcaacactgaactgcaactgtggcagatggagagcttttttgcaaaatatccacaagctggagcaggagaaaaacctagggaacaagtgctggaaacagtgaaaaacaatatagagtggctaaaacaacatagaaacaccatcagagaatgaagcaaaaacatattaacatcataacttaccagaaaaaccccactatcctcataagattaacttaaaattctgaccacaatcagaaccagcacttgaagtctatgtattgtttcaagtaggacatattatgaggcagaaacgtccagagccagcacttggtttgccatgttctccgtgtttcttctgctcctagatgcagcagtattccagatagaggccgcactatgagcctgaattccaggataaaaacaacatggaatagaacttagccagcacagagtacacatgtgctgtaaatgagaaatacccctttgttattgtaaatcactgagattttgaggttgtctgttactgcagcataatctagcctaatataaacaccaaactaatatactcctctaccatagtaatttatttcttgttctttctcctcctccttcctctacttcagggtttagcgaccttttgcctgcctgtttttgtaaggcctgaaagctaaacatagttttacatttttagatggttgaaaaaatcaaaaggagaataatagttcatgatgtaaaaattatataaaatttaaataaatgtcggcatccttaaataaagttttattggaacacagcaca

SEQ ID NO: 286192 - DNA, 426 bp, Homo sapiens
atttaaatttctgtaccagtaggaagatgcatagagtattaggataacgatgctggaggtgttctgccgtaacggaaacacagaaaggcagccgctgaaagggcatgtgtgggtaattagttctcactatggttagactcctgaagtgagtggtccaagttgttagcgtgcttctgctctgtgaggccaggccagtatcctgtctgcatggctgaagacgaatcactggtatgtacatgttctagcttgggggaagaggagagaaaaaccaggaagtctaggcaagcaatttccctttatttaagcaaggaagctgcagctgaacattgtgctaatgttctgttggtaagaattgggttacctgtggacatctagctatgagagagcctgagaaacagtctctagcagggcgctcatgtgtgcaga

SEQ ID NO: 286193 - DNA, 4974 bp, Homo sapiens
  misc_feature (965)..(965): n is a, c, g, or t
ggggtaggggtggagatgcgtcgtttataaggggagctgtgacaatcttcttgccagccctcttcctcccactcggctcctcttacggagtcctcattccaccccccttgtttccgcattcatcctgagtggctggtgggaacgtgaaaagggagaggaaaaggcgcaagaagccagagagaggggtgtgggaaaagcgaaaacaggctgccaaatcaggggattccttccaatttaaaaaggaagtctgctgacgttagttagttaaatttaacatctttttatgtgtaacacttgactttggaagcaaaaatgaactttgcggagagagagggctctaagagatactgcattcaaacgaaacatgtggccattctctgtgcggtggtggtgggtgtaggattaatagtgggacttgccgtgggcttgaccagatcgtgtgactccagcggggacggcgggccgggcactgcgccagctccttcccacctgccttcttccacggccagcccctcaggtcctcctgcccaggaccaggacatctgcccggccagtgaggatgagagcggacagtggaaaaactttcgactgccggacttcgtcaacccagtccactacgacctgcacgtgaagcccctgttggaggaggacacctacacgggcaccgtgagcatctccatcaacctgagcgctcccacccggtacctgtggctgcacctccgggagaccaggatcacccggctcccggagctgaagaggccctctggggaccaggtgcaagtccggaggtgtttcgagtacaaaaagcaggagtacgtggtggtcgaggcggaggaagagcttacccccagcagtggagatggcctgtatctcctgaccatggagttcgccggctggctgaacggctccctcgtgggattttatagaaccacctacacggagaacggacgagtcaagagcatagnggccaccgatcatgaaccaacagatgccaggaaatcttttccttgttttgatgagcccaacaaaaaggcaacttatacaatatctatcacccatcccaaagaatacggagcactttcaaatatgccagtggcgaaagaagagtcagtggatgataaatggactcgaacaacttttgagaagtctgtccccatgagcacgtacctggtgtgctttgctgtacatcaatttgactctgtaaagagaatatcaaatagtggaaaacctcttacaatttatgtccagccagagcaaaagcacacagccgaatatgctgcaaacataactaaaagtgtgtttgattattttgaagaatactttgctatgaattattctcttcctaaattagataaaatcgctattccagattttggcactggtgccatggagaactggggactcatcacgtacagagaaacgaacctgctttatgaccctaaggaatcagcctcatcaaaccaacagagggtggccactgtggttgcccatgaacttgtgcatcagtggtttggaaatattgtgaccatggactggtgggaagacttgtggctaaatgaaggatttgcttctttctttgagtttctgggagtaaaccatgcagaaacagactggcaaatgcgtgaccaaatgttacttgaagatgtattacctgttcaagaggatgattctttgatgtcttcgcatccaattattgtgactgtgacaacccctgatgaaataacatctgtttttgatggaatatcctatagcaagggatcttctattttgagaatgcttgaagactggataaaaccagagaattttcaaaaaggatgtcagatgtacttggaaaaataccaattcaagaatgcaaaaacttctgatttttgggcagcactggaagaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttggttatacatggaatatcccagttaaatggactgaagataatataacaagcagtgtgttatttaataggtcagaaaaagaaggaatcactttgaactcctctaatcctagtggaaatgcttttctcaaaataaacccagatcatattgggttttatcgtgtaaattatgaagtagcaacttgggactcgatagctacagcgctctccttgaaccacaagacattttcttcagcagatcgtgcaagtcttattgatgatgcttttgccttggcaagagctcaacttctagattataaggtggctttgaacttgaccaagtatctcaaaagggaagagaattttttaccatggcagagagtaatttcagctgtaacctacatcattagcatgtttgaagatgataaagagctatatcctatgattgaggaatacttccaaggtcaagtgaagcctattgcagattctctgggatggaatgatgctggagaccatgtcacaaagttactccgttcctccgtgttagggtttgcgtgcaagatgggagacagagaagccttgaacaatgcttcctcgttatttgagcagtggctaaatgggactgtaagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtatttggatttgctcaaggacacgaaccttattaaaactcaggatgtgtttacagtcattcgatatatctcatataacagctatgggaagaacatggcctggaattggatacaactcaactgggactatctagtcaacagatatacactcaataacagaaaccttggccgaattgtcacaatagcagagccattcaacactgaactgcaactgtggcagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaatgtattcaaatgttagagtttaattttgtgaatctattgtttctcctctgaagcatttggtggcctaatttacaagcacgatggagagagccttataaacagataatgcttttactaagcactgtgtttatatgtcttgcaaagcctttaaattgttcctctttgtttatgaagaaagatactaatagagtacttaatatactcagggattccttctaagtgtacttcataagatattctttacaaactgaagataatgaaatagttattttaatacctttaaatatcattctttgtatcttaaatctgtgaagtagaacaatttggtcttagctttacattttcagtaccaaagaaacaccacttaatcttctctcttgattgatttttaaagtttaaataccagtacttgagggaccaatattaccatcttaatctttattttattattcagaattatacagacctaatatcattttattcacatatgtcttactactttaaatcctaccaaagtaacctgggcttaagttttacttgaggatcatatgaattagccaaaagaatggctgactgttgcctttgctcttataaaatcaataagagaactctcctctttttttaaaaataaatctaaatgattatcttgaaaaagtattgttttccagtgtcacttgactcttgaataaaaataactgcagtgttccccaaataatttaacacattgcaaatatgattcaagaatctggcctttttcatgcttggtactctcttctcttgctccattccttacaaagctccttcaaatatgctatgaaattagagggaacatagtgcttaactctgctccatggattttagaggaaaaaagctaaataattggaaactgttcaggaaagagagaaggcagattatttcttaaaactaaatggaattagaatttagctttgacctcacctagcaatctaagtgtgaaaatggggagacctgtgggcatccccagcatgactctgcatatctgagcatatatctccttatagatcaattttatgtataaacccttagatcctaatccatacagaatagcactgatcaaatttaaatgcatgacttgattaaagacatcaatttcatagaagctggtggcaagaatatgtttaatatggcacttgatacctcctagatccataatgtaagtccaataggcagaaaagatggtaagttactatgtttcaatctgctatatctagaaaatctaaatttatttggaactttcaaaaatgtaaggtaatttagaatcggcttgatgagaattgaagcatatggaaacaaaaccttagctttaactttatttatacaataatgtgccctaatcatgtactctgaaactttataaactttcctgttgctgtttcttaattatcacttctcaatccgtacagccaaactagtaaattcaaatgtagactgggttgtgggtggcagatatagaagaagaaatttccagaccaaaaaatattaaatattattttaaattatttcagaagcaaaaacatattaacatcataacttaccagaaaaaccccactatcctcataagattaacttaaaattctgaccacaatcagaaccagcacttgaagtctatgtattgtttcaagtaggacatattatgaggtgagatggtttatccttctgttttatgaaattaatacattttaaaagaaaaatgttagtttaagggggtggtaaataaaacagatttcaacttgcctacaagacattcta

SEQ ID NO: 286194 - DNA, 5357 bp, Homo sapiens
  misc_feature (965)..(965): n is a, c, g, or t
ggggtaggggtggagatgcgtcgtttataaggggagctgtgacaatcttcttgccagccctcttcctcccactcggctcctcttacggagtcctcattccaccccccttgtttccgcattcatcctgagtggctggtgggaacgtgaaaagggagaggaaaaggcgcaagaagccagagagaggggtgtgggaaaagcgaaaacaggctgccaaatcaggggattccttccaatttaaaaaggaagtctgctgacgttagttagttaaatttaacatctttttatgtgtaacacttgactttggaagcaaaaatgaactttgcggagagagagggctctaagagatactgcattcaaacgaaacatgtggccattctctgtgcggtggtggtgggtgtaggattaatagtgggacttgccgtgggcttgaccagatcgtgtgactccagcggggacggcgggccgggcactgcgccagctccttcccacctgccttcttccacggccagcccctcaggtcctcctgcccaggaccaggacatctgcccggccagtgaggatgagagcggacagtggaaaaactttcgactgccggacttcgtcaacccagtccactacgacctgcacgtgaagcccctgttggaggaggacacctacacgggcaccgtgagcatctccatcaacctgagcgctcccacccggtacctgtggctgcacctccgggagaccaggatcacccggctcccggagctgaagaggccctctggggaccaggtgcaagtccggaggtgtttcgagtacaaaaagcaggagtacgtggtggtcgaggcggaggaagagcttacccccagcagtggagatggcctgtatctcctgaccatggagttcgccggctggctgaacggctccctcgtgggattttatagaaccacctacacggagaacggacgagtcaagagcatagnggccaccgatcatgaaccaacagatgccaggaaatcttttccttgttttgatgagcccaacaaaaaggcaacttatacaatatctatcacccatcccaaagaatacggagcactttcaaatatgccagtggcgaaagaagagtcagtggatgataaatggactcgaacaacttttgagaagtctgtccccatgagcacgtacctggtgtgctttgctgtacatcaatttgactctgtaaagagaatatcaaatagtggaaaacctcttacaatttatgtccagccagagcaaaagcacacagccgaatatgctgcaaacataactaaaagtgtgtttgattattttgaagaatactttgctatgaattattctcttcctaaattagataaaatcgctattccagattttggcactggtgccatggagaactggggactcatcacgtacagagaaacgaacctgctttatgaccctaaggaatcagcctcatcaaaccaacagagggtggccactgtggttgcccatgaacttgtgcatcagtggtttggaaatattgtgaccatggactggtgggaagacttgtggctaaatgaaggatttgcttctttctttgagtttctgggagtaaaccatgcagaaacagactggcaaatgcgtgaccaaatgttacttgaagatgtattacctgttcaagaggatgattctttgatgtcttcgcatccaattattgtgactgtgacaacccctgatgaaataacatctgtttttgatggaatatcctatagcaagggatcttctattttgagaatgcttgaagactggataaaaccagagaattttcaaaaaggatgtcagatgtacttggaaaaataccaattcaagaatgcaaaaacttctgatttttgggcagcactggaagaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttggttatacatggaatatcccagttaaatggactgaagataatataacaagcagtgtgttatttaataggtcagaaaaagaaggaatcactttgaactcctctaatcctagtggaaatgcttttctcaaaataaacccagatcatattgggttttatcgtgtaaattatgaagtagcaacttgggactcgatagctacagcgctctccttgaaccacaagacattttcttcagcagatcgtgcaagtcttattgatgatgcttttgccttggcaagagctcaacttctagattataaggtggctttgaacttgaccaagtatctcaaaagggaagagaattttttaccatggcagagagtaatttcagctgtaacctacatcattagcatgtttgaagatgataaagagctatatcctatgattgaggaatacttccaaggtcaagtgaagcctattgcagattctctgggatggaatgatgctggagaccatgtcacaaagttactccgttcctccgtgttagggtttgcgtgcaagatgggagacagagaagccttgaacaatgcttcctcgttatttgagcagtggctaaatgggactgtaagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtatttggatttgctcaaggacacgaaccttattaaaactcaggatgtgtttacagtcattcgatatatctcatataacagctatgggaagaacatggcctggaattggatacaactcaactgggactatctagtcaacagatatacactcaataacagaaaccttggccgaattgtcacaatagcagagccattcaacactgaactgcaactgtggcagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaatgtattcaaatgttagagtttaattttgtgaatctattgtttctcctctgaagcatttggtggcctaatttacaagcacgatggagagagccttataaacagataatgcttttactaagcactgtgtttatatgtcttgcaaagcctttaaattgttcctctttgtttatgaagaaagatactaatagagtacttaatatactcagggattccttctaagtgtacttcataagatattctttacaaactgaagataatgaaatagttattttaatacctttaaatatcattctttgtatcttaaatctgtgaagtagaacaatttggtcttagctttacattttcagtaccaaagaaacaccacttaatcttctctcttgattgatttttaaagtttaaataccagtacttgagggaccaatattaccatcttaatctttattttattattcagaattatacagacctaatatcattttattcacatatgtcttactactttaaatcctaccaaagtaacctgggcttaagttttacttgaggatcatatgaattagccaaaagaatggctgactgttgcctttgctcttataaaatcaataagagaactctcctctttttttaaaaataaatctaaatgattatcttgaaaaagtattgttttccagtgtcacttgactcttgaataaaaataactgcagtgttccccaaataatttaacacattgcaaatatgattcaagaatctggcctttttcatgcttggtactctcttctcttgctccattccttacaaagctccttcaaatatgctatgaaattagagggaacatagtgcttaactctgctccatggattttagaggaaaaaagctaaataattggaaactgttcaggaaagagagaaggcagattatttcttaaaactaaatggaattagaatttagctttgacctcacctagcaatctaagtgtgaaaatggggagacctgtgggcatccccagcatgactctgcatatctgagcatatatctccttatagatcaattttatgtataaacccttagatcctaatccatacagaatagcactgatcaaatttaaatgcatgacttgattaaagacatcaatttcatagaagctggtggcaagaatatgtttaatatggcacttgatacctcctagatccataatgtaagtccaataggcagaaaagatggtaagttactatgtttcaatctgctatatctagaaaatctaaatttatttggaactttcaaaaatgtaaggtaatttagaatcggcttgatgagaattgaagcatatggaaacaaaaccttagctttaactttatttatacaataatgtgccctaatcatgtactctgaaactttataaactttcctgttgctgtttcttaattatcacttctcaatccgtacagccaaactagtaaattcaaatgtagactgggttgtgggtggcagatatagaagaagaaatttccagaccaaaaaatattaaatattattttaaattatttcagaagcaaaaacatattaacatcataacttaccagaaaaaccccactatcctcataagattaacttaaaattctgaccacaatcagaaccagcacttgaagtctatgtattgtttcaagtaggacatattatgaggcagaaacgtccagagccagcacttggtttgccatgttctccgtgtttcttctgctcctagatgcagcagtattccagatagaggccgcactatgagcctgaattccaggataaaaacaacatggaatagaacttagccagcacagagtacacatgtgctgtaaatgagaaatacccctttgttattgtaaatcactgagattttgaggttgtctgttactgcagcataatctagcctaatataaacaccaaactaatatactcctctaccatagtaatttatttcttgttctttctcctcctccttcctctacttcagggtttagcgaccttttgcctgcctgtttttgtaaggcctgaaagctaaacatagttttacatttttagatggttgaaaaaatcaaaaggagaataatagttcatgatgtaaaaattatataaaatttaaataaatgtcggcatccttaaataaagttttattggaacacagcaca

SEQ ID NO: 286195 - DNA, 3836 bp, Homo sapiens
  misc_feature (965)..(965): n is a, c, g, or t
ggggtaggggtggagatgcgtcgtttataaggggagctgtgacaatcttcttgccagccctcttcctcccactcggctcctcttacggagtcctcattccaccccccttgtttccgcattcatcctgagtggctggtgggaacgtgaaaagggagaggaaaaggcgcaagaagccagagagaggggtgtgggaaaagcgaaaacaggctgccaaatcaggggattccttccaatttaaaaaggaagtctgctgacgttagttagttaaatttaacatctttttatgtgtaacacttgactttggaagcaaaaatgaactttgcggagagagagggctctaagagatactgcattcaaacgaaacatgtggccattctctgtgcggtggtggtgggtgtaggattaatagtgggacttgccgtgggcttgaccagatcgtgtgactccagcggggacggcgggccgggcactgcgccagctccttcccacctgccttcttccacggccagcccctcaggtcctcctgcccaggaccaggacatctgcccggccagtgaggatgagagcggacagtggaaaaactttcgactgccggacttcgtcaacccagtccactacgacctgcacgtgaagcccctgttggaggaggacacctacacgggcaccgtgagcatctccatcaacctgagcgctcccacccggtacctgtggctgcacctccgggagaccaggatcacccggctcccggagctgaagaggccctctggggaccaggtgcaagtccggaggtgtttcgagtacaaaaagcaggagtacgtggtggtcgaggcggaggaagagcttacccccagcagtggagatggcctgtatctcctgaccatggagttcgccggctggctgaacggctccctcgtgggattttatagaaccacctacacggagaacggacgagtcaagagcatagnggccaccgatcatgaaccaacagatgccaggaaatcttttccttgttttgatgagcccaacaaaaaggcaacttatacaatatctatcacccatcccaaagaatacggagcactttcaaatatgccagtggcgaaagaagagtcagtggatgataaatggactcgaacaacttttgagaagtctgtccccatgagcacgtacctggtgtgctttgctgtacatcaatttgactctgtaaagagaatatcaaatagtggaaaacctcttacaatttatgtccagccagagcaaaagcacacagccgaatatgctgcaaacataactaaaagtgtgtttgattattttgaagaatactttgctatgaattattctcttcctaaattagataaaatcgctattccagattttggcactggtgccatggagaactggggactcatcacgtacagagaaacgaacctgctttatgaccctaaggaatcagcctcatcaaaccaacagagggtggccactgtggttgcccatgaacttgtgcatcagtggtttggaaatattgtgaccatggactggtgggaagacttgtggctaaatgaaggatttgcttctttctttgagtttctgggagtaaaccatgcagaaacagactggcaaatgcgtgaccaaatgttacttgaagatgtattacctgttcaagaggatgattctttgatgtcttcgcatccaattattgtgactgtgacaacccctgatgaaataacatctgtttttgatggaatatcctatagcaagggatcttctattttgagaatgcttgaagactggataaaaccagagaattttcaaaaaggatgtcagatgtacttggaaaaataccaattcaagaatgcaaaaacttctgatttttgggcagcactggaagaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttggttatacatggaatatcccagttaaatggactgaagataatataacaagcagtgtgttatttaataggtcagaaaaagaaggaatcactttgaactcctctaatcctagtggaaatgcttttctcaaaataaacccagatcatattgggttttatcgtgtaaattatgaagtagcaacttgggactcgatagctacagcgctctccttgaaccacaagacattttcttcagcagatcgtgcaagtcttattgatgatgcttttgccttggcaagagctcaacttctagattataaggtggctttgaacttgaccaagtatctcaaaagggaagagaattttttaccatggcagagagtaatttcagctgtaacctacatcattagcatgtttgaagatgataaagagctatatcctatgattgaggaatacttccaaggtcaagtgaagcctattgcagattctctgggatggaatgatgctggagaccatgtcacaaagttactccgttcctccgtgttagggtttgcgtgcaagatgggagacagagaagccttgaacaatgcttcctcgttatttgagcagtggctaaatgggactgtaagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtatttggatttgctcaaggacacgaaccttattaaaactcaggatgtgtttacagtcattcgatatatctcatataacagctatgggaagaacatggcctggaattggatacaactcaactgggactatctagtcaacagatatacactcaataacagaaaccttggccgaattgtcacaatagcagagccattcaacactgaactgcaactgtggcagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaatgtattcaaatgttagagtttaattttgtgaatctattgtttctcctctgaagcatttggtggcctaatttacaagcacgatggagagagccttataaacagataatgcttttactaagcactgtgtttatatgtcttgcaaagcctttaaattgttcctctttgtttatgaagaaagatactaatagagtacttaatatactcagggattccttctaagtgtacttcataagatattctttacaaactgaagataatgaaatagttattttaatacctttaaatatcattctttgtatcttaaatctgtgaagtagaacaatttggtcttagctttacattttcagtaccaaagaaacaccacttaatcttctctcttgattgatttttaaagtttaaataccagtacttgagggaccaatattaccatcttaatctttattttattattcagaattatacagacctaatatcattttattcacatatgtcttactactttaaatcctaccaaagtaacctgggcttaagttttacttgaggatcatatgaattagccaaaagaatggctgactgttgcctttgctcttataaaatcaataagagaactctcctctttttttaaaaataaatctaaatgattatcttga

SEQ ID NO: 286196 - DNA, 4426 bp, Homo sapiens
  misc_feature (417)..(417): n is a, c, g, or t
gcagacatctgtgctagcaatcaacgagactccgtgggcgtagaaccctctgagccaggtgtgggatataatctcgtggtgcgccgttttttaagccagtcggaaaagcgcagtattcgggtgggagtgacccgattttccaggtgaatccgtcacccctttctttgactcggaaagggaactccctgaccccttgcgcttcccaagtgaggcaatgcctcgccctgcttcggctcgcgcacggtgcgcgcacccactgacctgcgcccactgtctggcactccctagtgagatgaacccggtacctcagatggaaatgcagaaatcacccgtcttctgcgtcgtcacgctgggagctgtagaccagagctgtttcctattcggcaatcttggctcctccacagagcggagcatagnggccaccgatcatgaaccaacagatgccaggaaatcttttccttgttttgatgagcccaacaaaaaggcaacttatacaatatctatcacccatcccaaagaatacggagcactttcaaatatgccagtggcgaaagaagagtcagtggatgataaatggactcgaacaacttttgagaagtctgtccccatgagcacgtacctggtgtgctttgctgtacatcaatttgactctgtaaagagaatatcaaatagtggaaaacctcttacaatttatgtccagccagagcaaaagcacacagccgaatatgctgcaaacataactaaaagtgtgtttgattattttgaagaatactttgctatgaattattctcttcctaaattagataaaatcgctattccagattttggcactggtgccatggagaactggggactcatcacgtacagagaaacgaacctgctttatgaccctaaggaatcagcctcatcaaaccaacagagggtggccactgtggttgcccatgaacttgtgcatcagtggtttggaaatattgtgaccatggactggtgggaagacttgtggctaaatgaaggatttgcttctttctttgagtttctgggagtaaaccatgcagaaacagactggcaaatgcgtgaccaaatgttacttgaagatgtattacctgttcaagaggatgattctttgatgtcttcgcatccaattattgtgactgtgacaacccctgatgaaataacatctgtttttgatggaatatcctatagcaagggatcttctattttgagaatgcttgaagactggataaaaccagagaattttcaaaaaggatgtcagatgtacttggaaaaataccaattcaagaatgcaaaaacttctgatttttgggcagcactggaagaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttggttatacatggaatatcccagttaaatggactgaagataatataacaagcagtgtgttatttaataggtcagaaaaagaaggaatcactttgaactcctctaatcctagtggaaatgcttttctcaaaataaacccagatcatattgggttttatcgtgtaaattatgaagtagcaacttgggactcgatagctacagcgctctccttgaaccacaagacattttcttcagcagatcgtgcaagtcttattgatgatgcttttgccttggcaagagctcaacttctagattataaggtggctttgaacttgaccaagtatctcaaaagggaagagaattttttaccatggcagagagtaatttcagctgtaacctacatcattagcatgtttgaagatgataaagagctatatcctatgattgaggaatacttccaaggtcaagtgaagcctattgcagattctctgggatggaatgatgctggagaccatgtcacaaagttactccgttcctccgtgttagggtttgcgtgcaagatgggagacagagaagccttgaacaatgcttcctcgttatttgagcagtggctaaatgggactgtaagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtatttggatttgctcaaggacacgaaccttattaaaactcaggatgtgtttacagtcattcgatatatctcatataacagctatgggaagaacatggcctggaattggatacaactcaactgggactatctagtcaacagatatacactcaataacagaaaccttggccgaattgtcacaatagcagagccattcaacactgaactgcaactgtggcagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaatgtattcaaatgttagagtttaattttgtgaatctattgtttctcctctgaagcatttggtggcctaatttacaagcacgatggagagagccttataaacagataatgcttttactaagcactgtgtttatatgtcttgcaaagcctttaaattgttcctctttgtttatgaagaaagatactaatagagtacttaatatactcagggattccttctaagtgtacttcataagatattctttacaaactgaagataatgaaatagttattttaatacctttaaatatcattctttgtatcttaaatctgtgaagtagaacaatttggtcttagctttacattttcagtaccaaagaaacaccacttaatcttctctcttgattgatttttaaagtttaaataccagtacttgagggaccaatattaccatcttaatctttattttattattcagaattatacagacctaatatcattttattcacatatgtcttactactttaaatcctaccaaagtaacctgggcttaagttttacttgaggatcatatgaattagccaaaagaatggctgactgttgcctttgctcttataaaatcaataagagaactctcctctttttttaaaaataaatctaaatgattatcttgaaaaagtattgttttccagtgtcacttgactcttgaataaaaataactgcagtgttccccaaataatttaacacattgcaaatatgattcaagaatctggcctttttcatgcttggtactctcttctcttgctccattccttacaaagctccttcaaatatgctatgaaattagagggaacatagtgcttaactctgctccatggattttagaggaaaaaagctaaataattggaaactgttcaggaaagagagaaggcagattatttcttaaaactaaatggaattagaatttagctttgacctcacctagcaatctaagtgtgaaaatggggagacctgtgggcatccccagcatgactctgcatatctgagcatatatctccttatagatcaattttatgtataaacccttagatcctaatccatacagaatagcactgatcaaatttaaatgcatgacttgattaaagacatcaatttcatagaagctggtggcaagaatatgtttaatatggcacttgatacctcctagatccataatgtaagtccaataggcagaaaagatggtaagttactatgtttcaatctgctatatctagaaaatctaaatttatttggaactttcaaaaatgtaaggtaatttagaatcggcttgatgagaattgaagcatatggaaacaaaaccttagctttaactttatttatacaataatgtgccctaatcatgtactctgaaactttataaactttcctgttgctgtttcttaattatcacttctcaatccgtacagccaaactagtaaattcaaatgtagactgggttgtgggtggcagatatagaagaagaaatttccagaccaaaaaatattaaatattattttaaattatttcagaagcaaaaacatattaacatcataacttaccagaaaaaccccactatcctcataagattaacttaaaattctgaccacaatcagaaccagcacttgaagtctatgtattgtttcaagtaggacatattatgaggtgagatggtttatccttctgttttatgaaattaatacattttaaaagaaaaatgttagtttaagggggtggtaaataaaacagatttcaacttgcctacaagacattcta

SEQ ID NO: 286197 - DNA, 3237 bp, Homo sapiens
tgcattttctcaatttgctggccagcataatttcacaaagcccctgacactgtggcaagtgtagctctccggagggatgctttgaagacatggcagggtagagcacacggctcccacatctcttgcctgggtcgctgtattccagaaaaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttggttatacatggaatatcccagttaaatggactgaagataatataacaagcagtgtgttatttaataggtcagaaaaagaaggaatcactttgaactcctctaatcctagtggaaatgcttttctcaaaataaacccagatcatattgggttttatcgtgtaaattatgaagtagcaacttgggactcgatagctacagcgctctccttgaaccacaagacattttcttcagcagatcgtgcaagtcttattgatgatgcttttgccttggcaagagctcaacttctagattataaggtggctttgaacttgaccaagtatctcaaaagggaagagaattttttaccatggcagagagtaatttcagctgtaacctacatcattagcatgtttgaagatgataaagagctatatcctatgattgaggaatacttccaaggtcaagtgaagcctattgcagattctctgggatggaatgatgctggagaccatgtcacaaagttactccgttcctccgtgttagggtttgcgtgcaagatgggagacagagaagccttgaacaatgcttcctcgttatttgagcagtggctaaatgggactgtaagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtatttggatttgctcaaggacacgaaccttattaaaactcaggatgtgtttacagtcattcgatatatctcatataacagctatgggaagaacatggcctggaattggatacaactcaactgggactatctagtcaacagatatacactcaataacagaaaccttggccgaattgtcacaatagcagagccattcaacactgaactgcaactgtggcagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaatgtattcaaatgttagagtttaattttgtgaatctattgtttctcctctgaagcatttggtggcctaatttacaagcacgatggagagagccttataaacagataatgcttttactaagcactgtgtttatatgtcttgcaaagcctttaaattgttcctctttgtttatgaagaaagatactaatagagtacttaatatactcagggattccttctaagtgtacttcataagatattctttacaaactgaagataatgaaatagttattttaatacctttaaatatcattctttgtatcttaaatctgtgaagtagaacaatttggtcttagctttacattttcagtaccaaagaaacaccacttaatcttctctcttgattgatttttaaagtttaaataccagtacttgagggaccaatattaccatcttaatctttattttattattcagaattatacagacctaatatcattttattcacatatgtcttactactttaaatcctaccaaagtaacctgggcttaagttttacttgaggatcatatgaattagccaaaagaatggctgactgttgcctttgctcttataaaatcaataagagaactctcctctttttttaaaaataaatctaaatgattatcttgaaaaagtattgttttccagtgtcacttgactcttgaataaaaataactgcagtgttccccaaataatttaacacattgcaaatatgattcaagaatctggcctttttcatgcttggtactctcttctcttgctccattccttacaaagctccttcaaatatgctatgaaattagagggaacatagtgcttaactctgctccatggattttagaggaaaaaagctaaataattggaaactgttcaggaaagagagaaggcagattatttcttaaaactaaatggaattagaatttagctttgacctcacctagcaatctaagtgtgaaaatggggagacctgtgggcatccccagcatgactctgcatatctgagcatatatctccttatagatcaattttatgtataaacccttagatcctaatccatacagaatagcactgatcaaatttaaatgcatgacttgattaaagacatcaatttcatagaagctggtggcaagaatatgtttaatatggcacttgatacctcctagatccataatgtaagtccaataggcagaaaagatggtaagttactatgtttcaatctgctatatctagaaaatctaaatttatttggaactttcaaaaatgtaaggtaatttagaatcggcttgatgagaattgaagcatatggaaacaaaaccttagctttaactttatttatacaataatgtgccctaatcatgtactctgaaactttataaactttcctgttgctgtttcttaattatcacttctcaatccgtacagccaaactagtaaattcaaatgtagactgggttgtgggtggcagatatagaagaagaaatttccagaccaaaaaatattaaatattattttaaattatttcagaagcaaaaacatattaacatcataacttaccagaaaaaccccactatcctcataagattaacttaaaattctgaccacaatcagaaccagcacttgaagtctatgtattgtttcaagtaggacatattatgaggtgagatggtttatccttctgttttatgaaattaatacattttaaaagaaaaatgttagtttaagggggtggtaaataaaacagatttcaacttgcctacaagacattcta

SEQ ID NO: 286198 - DNA, 4921 bp, Homo sapiens
  misc_feature (965)..(965): n is a, c, g, or t
ggggtaggggtggagatgcgtcgtttataaggggagctgtgacaatcttcttgccagccctcttcctcccactcggctcctcttacggagtcctcattccaccccccttgtttccgcattcatcctgagtggctggtgggaacgtgaaaagggagaggaaaaggcgcaagaagccagagagaggggtgtgggaaaagcgaaaacaggctgccaaatcaggggattccttccaatttaaaaaggaagtctgctgacgttagttagttaaatttaacatctttttatgtgtaacacttgactttggaagcaaaaatgaactttgcggagagagagggctctaagagatactgcattcaaacgaaacatgtggccattctctgtgcggtggtggtgggtgtaggattaatagtgggacttgccgtgggcttgaccagatcgtgtgactccagcggggacggcgggccgggcactgcgccagctccttcccacctgccttcttccacggccagcccctcaggtcctcctgcccaggaccaggacatctgcccggccagtgaggatgagagcggacagtggaaaaactttcgactgccggacttcgtcaacccagtccactacgacctgcacgtgaagcccctgttggaggaggacacctacacgggcaccgtgagcatctccatcaacctgagcgctcccacccggtacctgtggctgcacctccgggagaccaggatcacccggctcccggagctgaagaggccctctggggaccaggtgcaagtccggaggtgtttcgagtacaaaaagcaggagtacgtggtggtcgaggcggaggaagagcttacccccagcagtggagatggcctgtatctcctgaccatggagttcgccggctggctgaacggctccctcgtgggattttatagaaccacctacacggagaacggacgagtcaagagcatagnggccaccgatcatgaaccaacagatgccaggaaatcttttccttgttttgatgagcccaacaaaaaggcaacttatacaatatctatcacccatcccaaagaatacggagcactttcaaatatgccagtggcgaaagaagagtcagtggatgataaatggactcgaacaacttttgagaagtctgtccccatgagcacgtacctggtgtgctttgctgtacatcaatttgactctgtaaagagaatatcaaatagtggaaaacctcttacaatttatgtccagccagagcaaaagcacacagccgaatatgctgcaaacataactaaaagtgtgtttgattattttgaagaatactttgctatgaattattctcttcctaaattagataaaatcgctattccagattttggcactggtgccatggagaactggggactcatcacgtacagagaaacgaacctgctttatgaccctaaggaatcagcctcatcaaaccaacagagggtggccactgtggttgcccatgaacttgtgcatcagtggtttggaaatattgtgaccatggactggtgggaagacttgtggctaaatgaaggatttgcttctttctttgagtttctgggagtaaaccatgcagaaacagactggcaaatgcgtgaccaaatgttacttgaagatgtattacctgttcaagaggatgattctttgatgtcttcgcatccaattattgtgactgtgacaacccctgatgaaataacatctgtttttgatggaatatcctatagcaagggatcttctattttgagaatgcttgaagactggataaaaccagagaattttcaaaaaggatgtcagatgtacttggaaaaataccaattcaagaatgcaaaaacttctgatttttgggcagcactggaagaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttggttatacatggaatatcccagttaaatggactgaagataatataacaagcagtgtgttatttaataggtcagaaaaagaaggaatcactttgaactcctctaatcctagtggaaatgcttttctcaaaataaacccagatcatattgggttttatcgtgtaaattatgaagtagcaacttgggactcgatagctacagcgctctccttgaaccacaagacattttcttcagcagatcgtgcaagtcttattgatgatgcttttgccttggcaagagctcaacttctagattataaggtggctttgaacttgaccaagtatctcaaaagggaagagaattttttaccatggcagagagtaatttcagctgtaacctacatcattagcatgtttgaagatgataaagagctatatcctatgattgaggaatacttccaaggtcaagtgaagcctattgcagattctctgggatggaatgatgctggagaccatgtcacaaagttactccgttcctccgtgttagggtttgcgtgcaagatgggagacagagaagccttgaacaatgcttcctcgttatttgagcagtggctaaatgggactgtaagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtatttggatttgctcaaggacacgaaccttattaaaaaacatggcctggaattggatacaactcaactgggactatctagtcaacagatatacactcaataacagaaaccttggccgaattgtcacaatagcagagccattcaacactgaactgcaactgtggcagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaatgtattcaaatgttagagtttaattttgtgaatctattgtttctcctctgaagcatttggtggcctaatttacaagcacgatggagagagccttataaacagataatgcttttactaagcactgtgtttatatgtcttgcaaagcctttaaattgttcctctttgtttatgaagaaagatactaatagagtacttaatatactcagggattccttctaagtgtacttcataagatattctttacaaactgaagataatgaaatagttattttaatacctttaaatatcattctttgtatcttaaatctgtgaagtagaacaatttggtcttagctttacattttcagtaccaaagaaacaccacttaatcttctctcttgattgatttttaaagtttaaataccagtacttgagggaccaatattaccatcttaatctttattttattattcagaattatacagacctaatatcattttattcacatatgtcttactactttaaatcctaccaaagtaacctgggcttaagttttacttgaggatcatatgaattagccaaaagaatggctgactgttgcctttgctcttataaaatcaataagagaactctcctctttttttaaaaataaatctaaatgattatcttgaaaaagtattgttttccagtgtcacttgactcttgaataaaaataactgcagtgttccccaaataatttaacacattgcaaatatgattcaagaatctggcctttttcatgcttggtactctcttctcttgctccattccttacaaagctccttcaaatatgctatgaaattagagggaacatagtgcttaactctgctccatggattttagaggaaaaaagctaaataattggaaactgttcaggaaagagagaaggcagattatttcttaaaactaaatggaattagaatttagctttgacctcacctagcaatctaagtgtgaaaatggggagacctgtgggcatccccagcatgactctgcatatctgagcatatatctccttatagatcaattttatgtataaacccttagatcctaatccatacagaatagcactgatcaaatttaaatgcatgacttgattaaagacatcaatttcatagaagctggtggcaagaatatgtttaatatggcacttgatacctcctagatccataatgtaagtccaataggcagaaaagatggtaagttactatgtttcaatctgctatatctagaaaatctaaatttatttggaactttcaaaaatgtaaggtaatttagaatcggcttgatgagaattgaagcatatggaaacaaaaccttagctttaactttatttatacaataatgtgccctaatcatgtactctgaaactttataaactttcctgttgctgtttcttaattatcacttctcaatccgtacagccaaactagtaaattcaaatgtagactgggttgtgggtggcagatatagaagaagaaatttccagaccaaaaaatattaaatattattttaaattatttcagaagcaaaaacatattaacatcataacttaccagaaaaaccccactatcctcataagattaacttaaaattctgaccacaatcagaaccagcacttgaagtctatgtattgtttcaagtaggacatattatgaggtgagatggtttatccttctgttttatgaaattaatacattttaaaagaaaaatgttagtttaagggggtggtaaataaaacagatttcaacttgcctacaagacattcta

SEQ ID NO: 286199 - DNA, 2242 bp, Homo sapiens
tcagagggtcgtgtcaatttgtctaccaaaagaagtgcagagtgtactaagaatttatcttgaatagaatgattttaagtaaaatgggttttcttactgtgttttgcttactttgaaagttacttttaaaaactatgaaataaaaaggaaacatctgcatttagagaaaatatgtaacattctgagcacttacacttccttttactctaaatttctctccagatatacactcaataacagaaaccttggccgaattgtcacaatagcagagccattcaacactgaactgcaactgtggcagatggagagcttttttgcaaaatatccacaagctggagcaggagaaaaacctagggaacaagtgctggaaacagtgaaaaacaatatagagtggctaaaacaacatagaaacaccatcagagaatggttttttaatttacttgagagtggttaatgtattcaaatgttagagtttaattttgtgaatctattgtttctcctctgaagcatttggtggcctaatttacaagcacgatggagagagccttataaacagataatgcttttactaagcactgtgtttatatgtcttgcaaagcctttaaattgttcctctttgtttatgaagaaagatactaatagagtacttaatatactcagggattccttctaagtgtacttcataagatattctttacaaactgaagataatgaaatagttattttaatacctttaaatatcattctttgtatcttaaatctgtgaagtagaacaatttggtcttagctttacattttcagtaccaaagaaacaccacttaatcttctctcttgattgatttttaaagtttaaataccagtacttgagggaccaatattaccatcttaatctttattttattattcagaattatacagacctaatatcattttattcacatatgtcttactactttaaatcctaccaaagtaacctgggcttaagttttacttgaggatcatatgaattagccaaaagaatggctgactgttgcctttgctcttataaaatcaataagagaactctcctctttttttaaaaataaatctaaatgattatcttgaaaaagtattgttttccagtgtcacttgactcttgaataaaaataactgcagtgttccccaaataatttaacacattgcaaatatgattcaagaatctggcctttttcatgcttggtactctcttctcttgctccattccttacaaagctccttcaaatatgctatgaaattagagggaacatagtgcttaactctgctccatggattttagaggaaaaaagctaaataattggaaactgttcaggaaagagagaaggcagattatttcttaaaactaaatggaattagaatttagctttgacctcacctagcaatctaagtgtgaaaatggggagacctgtgggcatccccagcatgactctgcatatctgagcatatatctccttatagatcaattttatgtataaacccttagatcctaatccatacagaatagcactgatcaaatttaaatgcatgacttgattaaagacatcaatttcatagaagctggtggcaagaatatgtttaatatggcacttgatacctcctagatccataatgtaagtccaataggcagaaaagatggtaagttactatgtttcaatctgctatatctagaaaatctaaatttatttggaactttcaaaaatgtaaggtaatttagaatcggcttgatgagaattgaagcatatggaaacaaaaccttagctttaactttatttatacaataatgtgccctaatcatgtactctgaaactttataaactttcctgttgctgtttcttaattatcacttctcaatccgtacagccaaactagtaaattcaaatgtagactgggttgtgggtggcagatatagaagaagaaatttccagaccaaaaaatattaaatattattttaaattatttcagaagcaaaaacatattaacatcataacttaccagaaaaaccccactatcctcataagattaacttaaaattctgaccacaatcagaaccagcacttgaagtctatgtattgtttcaagtaggacatattatgaggtgagatggtttatccttctgttttatgaaattaatacattttaaaagaaaaatgttagtttaagggggtggtaaataaaacagatttcaacttgcctacaagacattcta

SEQ ID NO: 286200 - DNA, 3305 bp, Homo sapiens
  misc_feature (965)..(965): n is a, c, g, or t
  misc_feature (3305)..(3305): n is a, c, g, or t
ggggtaggggtggagatgcgtcgtttataaggggagctgtgacaatcttcttgccagccctcttcctcccactcggctcctcttacggagtcctcattccaccccccttgtttccgcattcatcctgagtggctggtgggaacgtgaaaagggagaggaaaaggcgcaagaagccagagagaggggtgtgggaaaagcgaaaacaggctgccaaatcaggggattccttccaatttaaaaaggaagtctgctgacgttagttagttaaatttaacatctttttatgtgtaacacttgactttggaagcaaaaatgaactttgcggagagagagggctctaagagatactgcattcaaacgaaacatgtggccattctctgtgcggtggtggtgggtgtaggattaatagtgggacttgccgtgggcttgaccagatcgtgtgactccagcggggacggcgggccgggcactgcgccagctccttcccacctgccttcttccacggccagcccctcaggtcctcctgcccaggaccaggacatctgcccggccagtgaggatgagagcggacagtggaaaaactttcgactgccggacttcgtcaacccagtccactacgacctgcacgtgaagcccctgttggaggaggacacctacacgggcaccgtgagcatctccatcaacctgagcgctcccacccggtacctgtggctgcacctccgggagaccaggatcacccggctcccggagctgaagaggccctctggggaccaggtgcaagtccggaggtgtttcgagtacaaaaagcaggagtacgtggtggtcgaggcggaggaagagcttacccccagcagtggagatggcctgtatctcctgaccatggagttcgccggctggctgaacggctccctcgtgggattttatagaaccacctacacggagaacggacgagtcaagagcatagnggccaccgatcatgaaccaacagatgccaggaaatcttttccttgttttgatgagcccaacaaaaaggcaacttatacaatatctatcacccatcccaaagaatacggagcactttcaaatatgccagtggcgaaagaagagtcagtggatgataaatggactcgaacaacttttgagaagtctgtccccatgagcacgtacctggtgtgctttgctgtacatcaatttgactctgtaaagagaatatcaaatagtggaaaacctcttacaatttatgtccagccagagcaaaagcacacagccgaatatgctgcaaacataactaaaagtgtgtttgattattttgaagaatactttgctatgaattattctcttcctaaattagataaaatcgctattccagattttggcactggtgccatggagaactggggactcatcacgtacagagaaacgaacctgctttatgaccctaaggaatcagcctcatcaaaccaacagagggtggccactgtggttgcccatgaacttgtgcatcagtggtttggaaatattgtgaccatggactggtgggaagacttgtggctaaatgaaggatttgcttctttctttgagtttctgggagtaaaccatgcagaaacagactggcaaatgcgtgaccaaatgttacttgaagatgtattacctgttcaagaggatgattctttgatgtcttcgcatccaattattgtgactgtgacaacccctgatgaaataacatctgtttttgatggaatatcctatagcaagggatcttctattttgagaatgcttgaagactggataaaaccagagaattttcaaaaaggatgtcagatgtacttggaaaaataccaattcaagaatgcaaaaacttctgatttttgggcagcactggaagaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttggttatacatggaatatcccagttaaatggactgaagataatataacaagcagtgtgttatttaataggtcagaaaaagaaggaatcactttgaactcctctaatcctagtggaaatgcttttctcaaaataaacccagatcatattgggttttatcgtgtaaattatgaagtagcaacttgggactcgatagctacagcgctctccttgaaccacaagacattttcttcagcagatcgtgcaagtcttattgatgatgcttttgccttggcaagagctcaacttctagattataaggtggctttgaacttgaccaagtatctcaaaagggaagagaattttttaccatggcagagagtaatttcagctgtaacctacatcattagcatgtttgaagatgataaagagctatatcctatgattgaggaatacttccaaggtcaagtgaagcctattgcagattctctgggatggaatgatgctggagaccatgtcacaaagttactccgttcctccgtgttagggtttgcgtgcaagatgggagacagagaagccttgaacaatgcttcctcgttatttgagcagtggctaaatgggactgtaagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtatttggatttgctcaaggacacgaaccttattaaaactcaggatgtgtttacagtcattcgatatatctcatataacagctatgggaagaacatggcctggaattggatacaactcaactgggactatctagtcaacagatatacactcaataacagaaaccttggccgaattgtcacaatagcagagccattcaacactgaactgcaactgtggcagatggagaagtttttgaaatattcacaaggtgggcaggagaaaacctgggaccagtgtggggacgtggaaacatattgagtggttaaacaactagaaaccattagagatggtgttcaattcactgagaggggacggtgtcaaggggacgaaatcggagagactggggcctgagaatggggagtaaaacgggggagccttaaaaaggtcttacagggtttttggagcatgctttttgaaagaaaaaaataaggggggaataaggaagggagatn

SEQ ID NO: 286201 - DNA, 152 bp, Homo sapiens
ggtggctttgaacttgaccaagtatctcaaaagggaagagaattttttaccatggcagagagtaatttcagctgtaacctacatcattagcatgtttgaagatgataaagagctatatcctatgattgaggtgacgttaatgctatggtatc

SEQ ID NO: 286202 - DNA, 3229 bp, Homo sapiens
  misc_feature (965)..(965): n is a, c, g, or t
  misc_feature (3058)..(3058): n is a, c, g, or t
  misc_feature (3063)..(3064): n is a, c, g, or t
  misc_feature (3073)..(3073): n is a, c, g, or t
ggggtaggggtggagatgcgtcgtttataaggggagctgtgacaatcttcttgccagccctcttcctcccactcggctcctcttacggagtcctcattccaccccccttgtttccgcattcatcctgagtggctggtgggaacgtgaaaagggagaggaaaaggcgcaagaagccagagagaggggtgtgggaaaagcgaaaacaggctgccaaatcaggggattccttccaatttaaaaaggaagtctgctgacgttagttagttaaatttaacatctttttatgtgtaacacttgactttggaagcaaaaatgaactttgcggagagagagggctctaagagatactgcattcaaacgaaacatgtggccattctctgtgcggtggtggtgggtgtaggattaatagtgggacttgccgtgggcttgaccagatcgtgtgactccagcggggacggcgggccgggcactgcgccagctccttcccacctgccttcttccacggccagcccctcaggtcctcctgcccaggaccaggacatctgcccggccagtgaggatgagagcggacagtggaaaaactttcgactgccggacttcgtcaacccagtccactacgacctgcacgtgaagcccctgttggaggaggacacctacacgggcaccgtgagcatctccatcaacctgagcgctcccacccggtacctgtggctgcacctccgggagaccaggatcacccggctcccggagctgaagaggccctctggggaccaggtgcaagtccggaggtgtttcgagtacaaaaagcaggagtacgtggtggtcgaggcggaggaagagcttacccccagcagtggagatggcctgtatctcctgaccatggagttcgccggctggctgaacggctccctcgtgggattttatagaaccacctacacggagaacggacgagtcaagagcatagnggccaccgatcatgaaccaacagatgccaggaaatcttttccttgttttgatgagcccaacaaaaaggcaacttatacaatatctatcacccatcccaaagaatacggagcactttcaaatatgccagtggcgaaagaagagtcagtggatgataaatggactcgaacaacttttgagaagtctgtccccatgagcacgtacctggtgtgctttgctgtacatcaatttgactctgtaaagagaatatcaaatagtggaaaacctcttacaatttatgtccagccagagcaaaagcacacagccgaatatgctgcaaacataactaaaagtgtgtttgattattttgaagaatactttgctatgaattattctcttcctaaattagataaaatcgctattccagattttggcactggtgccatggagaactggggactcatcacgtacagagaaacgaacctgctttatgaccctaaggaatcagcctcatcaaaccaacagagggtggccactgtggttgcccatgaacttgtgcatcagtggtttggaaatattgtgaccatggactggtgggaagacttgtggctaaatgaaggatttgcttctttctttgagtttctgggagtaaaccatgcagaaacagactggcaaatgcgtgaccaaatgttacttgaagatgtattacctgttcaagaggatgattctttgatgtcttcgcatccaattattgtgactgtgacaacccctgatgaaataacatctgtttttgatggaatatcctatagcaagggatcttctattttgagaatgcttgaagactggataaaaccagagaattttcaaaaaggatgtcagatgtacttggaaaaataccaattcaagaatgcaaaaacttctgatttttgggcagcactggaagaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttggttatacatggaatatcccagttaaatggactgaagataatataacaagcagtgtgttatttaataggtcagaaaaagaaggaatcactttgaactcctctaatcctagtggaaatgcttttctcaaaataaacccagatcatattgggttttatcgtgtaaattatgaagtagcaacttgggactcgatagctacagcgctctccttgaaccacaagacattttcttcagcagatcgtgcaagtcttattgatgatgcttttgccttggcaagagctcaacttctagattataaggtggctttgaacttgaccaagtatctcaaaagggaagagaattttttaccatggcagagagtaatttcagctgtaacctacatcattagcatgtttgaagatgataaagagctatatcctatgattgaggaatacttccaaggtcaagtgaagcctattgcagattctctgggatggaatgatgctggagaccatgtcacaaagttactccgttcctccgtgttagggtttgcgtgcaagatgggagacagagaagccttgaacaatgcttcctcgttatttgagcagtggctaaatgggactgtaagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtatttggatttgctcaaggacacgaaccttattaaaactcaggatgtgtttacagtcattcgatatatctcatataacagctatgggaagaacatggcctggaattggatacaactcaactgggactatctagtcaacagatatacactcaataacagaaaccttggccgaattgtcacaatagcagagccattcaacactgaactgcaactgtggcagatggagagctttttttgcaaatatncacanngctgagcangagaccacatagaacaccattcgagatgggttttaattaccttggaatggtaaaggattcaatggtaagagttatttgggaatctatggtctcctttgaggaattgggggcctaataccaggcccatgtagaggctttaaaccggtaaggtttacc

SEQ ID NO: 286203 - DNA, 2396 bp, Homo sapiens
  misc_feature (965)..(965): n is a, c, g, or t
ggggtaggggtggagatgcgtcgtttataaggggagctgtgacaatcttcttgccagccctcttcctcccactcggctcctcttacggagtcctcattccaccccccttgtttccgcattcatcctgagtggctggtgggaacgtgaaaagggagaggaaaaggcgcaagaagccagagagaggggtgtgggaaaagcgaaaacaggctgccaaatcaggggattccttccaatttaaaaaggaagtctgctgacgttagttagttaaatttaacatctttttatgtgtaacacttgactttggaagcaaaaatgaactttgcggagagagagggctctaagagatactgcattcaaacgaaacatgtggccattctctgtgcggtggtggtgggtgtaggattaatagtgggacttgccgtgggcttgaccagatcgtgtgactccagcggggacggcgggccgggcactgcgccagctccttcccacctgccttcttccacggccagcccctcaggtcctcctgcccaggaccaggacatctgcccggccagtgaggatgagagcggacagtggaaaaactttcgactgccggacttcgtcaacccagtccactacgacctgcacgtgaagcccctgttggaggaggacacctacacgggcaccgtgagcatctccatcaacctgagcgctcccacccggtacctgtggctgcacctccgggagaccaggatcacccggctcccggagctgaagaggccctctggggaccaggtgcaagtccggaggtgtttcgagtacaaaaagcaggagtacgtggtggtcgaggcggaggaagagcttacccccagcagtggagatggcctgtatctcctgaccatggagttcgccggctggctgaacggctccctcgtgggattttatagaaccacctacacggagaacggacgagtcaagagcatagnggccaccgatcatgaaccaacagatgccaggaaatcttttccttgttttgatgagcccaacaaaaaggcaacttatacaatatctatcacccatcccaaagaatacggagcactttcaaatatgccagtggcgaaagaagagtcagtggatgataaatggactcgaacaacttttgagaagtctgtccccatgagcacgtacctggtgtgctttgctgtacatcaatttgactctgtaaagagaatatcaaatagtggaaaacctcttacaatttatgtccagccagagcaaaagcacacagccgaatatgctgcaaacataactaaaagtgtgtttgattattttgaagaatactttgctatgaattattctcttcctaaattagataaaatcgctattccagattttggcactggtgccatggagaactggggactcatcacgtacagagaaacgaacctgctttatgaccctaaggaatcagcctcatcaaaccaacagagggtggccactgtggttgcccatgaacttgtgcatcagtggtttggaaatattgtgaccatggactggtgggaagacttgtggctaaatgaaggatttgcttctttctttgagtttctgggagtaaaccatgcagaaacagactggcaaatgcgtgaccaaatgttacttgaagatgtattacctgttcaagaggatgattctttgatgtcttcgcatccaattattgtgactgtgacaacccctgatgaaataacatctgtttttgatggaatatcctatagcaagggatcttctattttgagaatgcttgaagactggataaaaccagagaattttcaaaaaggatgtcagatgtacttggaaaaataccaattcaagaatgcaaaaacttctgatttttgggcagcactggaagaggcaagtaggctaccagtgaaagaagtaatggacacctggaccagacagatgggttatcctgtgcttaacgtgaacggtgtcaagaacatcacacagaaacgctttttgttggacccaagagctaacccttctcagcccccttcagatcttggttatacatggaatatcccagttaaatggactgaagataatataacaagcagtgtgttatttaataggtcagaaaaagaagttaattgaggattggaagaatatctcggcagctgtttgatttactgtttacaagtttgaaagcgtgaataattcatctaccctagtacaattcacccagcactttcatggaatgaagtttccatacaagtgaattttccagataactaaagcttactcaagtgctttgtaaaatgcatttcaagagttcacaatagacattgttctaatatgtgttatgtactccttagaatatttggaataataaatttaatccttaattactagattaattcttt

SEQ ID NO: 286204 - DNA, 3341 bp, Homo sapiens
gcagagagggcactgggaggaggcagtgggagggcggagggcgggggcttcggggtgggcgcccagggtagggcaggtggccgccgcgtggaggcagggagaatgcactctccaaaaccctcgtcgacatggacatggccgactacagtgctgcactggacccagcctacaccaccctggaatttgagaatgtgcaggtgttgacgatgggcaatgatttgttgccgctgcgtctcgccagattgaggcatcccctccgacatcactggagcatatctggaggggtggacagttctccacagggagacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctcgtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattca

SEQ ID NO: 286205 - DNA, 1622 bp, Homo sapiens
  misc_feature (1611)..(1611): n is a, c, g, or t
  misc_feature (1614)..(1614): n is a, c, g, or t
  misc_feature (1616)..(1616): n is a, c, g, or t
  misc_feature (1618)..(1622): n is a, c, g, or t
gcagagagggcactgggaggaggcagtgggagggcggagggcgggggcttcggggtgggcgcccagggtagggcaggtggccgccgcgtggaggcagggagaatgcactctccaaaaccctcgtcgacatggacatggccgactacagtgctgcactggacccagcctacaccaccctggaatttgagaatgtgcaggtgttgacgatgggcaatgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggaggtccgtgccaagcccaggaggggcggggttggagtggggactccccaggagacaggcctcacacagtgagctcacccctcagctccttggcttccccactgtgccgctttgggcaagttgcttaacctgtctgtgcctcagtttcctcaccagaaaaatgggaacaaggcaatggtctatttgttcaggcaccgagaacctagcacgtgccagtcactgttctaatgctggcaattcagcaaagaacaagatctttgccctcggggaggctgtgtgtgtgtgagtatgtatggatgcgtggatatctgtgtatatgcccgtatgtgcgtgcatgtgtatataagcctcacattttatgattttgaaataaacaggtaatangananannnnn

SEQ ID NO: 286206 - DNA, 433 bp, Homo sapiens
gccctagttctgtcctaagaggaggaagttgtgtcttctccatccaaccatccaaagccctccccagatttagccggcagtgcgtggtggacaaagacaagaggaaccagtgccgctactgcaggctcaagaaatgcttccgggctggcatgaagaaggaaggtgagcctcggccctccccgccccaccaccactgccccacctgcacccacagctccccgacagtcatttacaactgtagccacactttatgactcagtggcaggccccagggtgactggctaatggctgagaagagggagggcctggaaatctgaccatagggagcggctgggcttggtcttgagaaagattcagagagataagctcccactcttggctcctcaggctcccagcaaccaccacccctgcctgcctgtctgcgccaccacaa

SEQ ID NO: 286207 - DNA, 3251 bp, Homo sapiens
gcagagagggcactgggaggaggcagtgggagggcggagggcgggggcttcggggtgggcgcccagggtagggcaggtggccgccgcgtggaggcagggagaatgcactctccaaaaccctcgtcgacatggacatggccgactacagtgctgcactggacccagcctacaccaccctggaatttgagaatgtgcaggtgttgacgatgggcaatgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctcgtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattca

SEQ ID NO: 286208 - DNA, 3221 bp, Homo sapiens
gcagagagggcactgggaggaggcagtgggagggcggagggcgggggcttcggggtgggcgcccagggtagggcaggtggccgccgcgtggaggcagggagaatgcactctccaaaaccctcgtcgacatggacatggccgactacagtgctgcactggacccagcctacaccaccctggaatttgagaatgtgcaggtgttgacgatgggcaatgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctcgtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattca

SEQ ID NO: 286209 - DNA, 749 bp, Homo sapiens
tttgctaggcaccggcagtggcggcggcagcggcggctggagcctctgattgggtttcggagtccggtactggagccaatcagcgcgggcagcgaaccgggggagcgaggcacggagtgtacctcacagccttctaggatctccagagtggacaggaatctcacttggagggaccatggagcagtatacagcaaacagcaatagttcgacagagcagattgttgtccaggcaggacagattcagcagcaggtccaagggcagccattaatggtgcaggtcagtggaggccagctaatcacatcaactggccaacccatcatggtccaggctgtccctggtggacaaggtcaaaccatcatgcaagtacctgtttctggaacacagggtttgcagcaaatacagttggtcccacctggacagatccagatccagggtggacaggctgtgcaggtgcagggccagcagggccagacccagcagatcatcatccagcagccccagacggctgtcactgctggccagactcagacacagcagcagattgctgtccagggacagcaagtggcacagactgctgaagggcagaccatcgtctatcaaccagttaatgcagatggcaccattctccagcaaggtaagtgtacccataagcttccctaggactttttggggcaacttttttgtcccttagacaactgacatctttagaatttgagtggtgaacttgacactacatattttttggaca

SEQ ID NO: 286210 - DNA, 884 bp, Homo sapiens
agcctgggcaaaacagcaagaccccatctcaaaataagtacataaataaagtttaaaaaaaaaagaatcttagttttgggacatgagagcattgacgtcatgaagatgatttcggttcatagtgattaattactcctcctttcttggtgattgcatttaagcccagaattttttatggtagtttcagggctattaaaacctaatcatttttttcttgtgaactcatctgaggagataaaaagggcattaaacaattgtgtaagtagaagtgtcagattcctgtttctggagggaaagattgcattacaaatctttgtgttaatgatgacaactgttttgagtttttgagtcaaatttttgaggtccactctggagacaaagggctaatatctttaatcctactaccttcaacaaaacagcttcaatatagggagtctgtacattttgaaagtccttcaggcttccgtctctctcctccaagaggtaaggtgatctgtgtcttgaactacacatttccttcctgacatatttcaagctcttcctgttcctgttctcagcagcagggtggtgtcactgctgtgcagttgcagactgaggcccaggtggcatccgcctcaggccagcaagtccagaccctccaggtagtggtaccctctctgattctctgtgagcactgcatgaacttctcctctcctcatgtctggtgctgtttgtgttaggatctccagtaggaatggcaaagtcagttgcatgtctttgatgctgctaacttgtctttgaggcttataagatgccagtttcctaatatttcatgccaagtcatatagagaccccgtatcaactttctgagaattggatttgactagcatgtttctttgagaatg

SEQ ID NO: 286211 - DNA, 4023 bp, Homo sapiens
tttgctaggcaccggcagtggcggcggcagcggcggctggagcctctgattgggtttcggagtccggtactggagccaatcagcgcgggcagcgaaccgggggagcgaggcacggagtgtacctcacagccttctaggatctccagagtggacaggaatctcacttggagggaccatggagcagtatacagcaaacagcaatagttcgacagagcagattgttgtccaggcaggacagattcagcagcagcagcagggtggtgtcactgctgtgcagttgcagactgaggcccaggtggcatccgcctcaggccagcaagtccagaccctccaggtagtccaagggcagccattaatggtgcaggtcagtggaggccagctaatcacatcaactggccaacccatcatggtccaggctgtccctggtggacaaggtcaaaccatcatgcaagtacctgtttctggaacacagggtttgcagcaaatacagttggtcccacctggacagatccagatccagggtggacaggctgtgcaggtgcagggccagcagggccagacccagcagatcatcatccagcagccccagacggctgtcactgctggccagactcagacacagcagcagattgctgtccagggacagcaagtggcacagactgctgaagggcagaccatcgtctatcaaccagttaatgcagatggcaccattctccagcaagttacagtccctgtttcaggcatgatcactatcccagcagccagtttggcaggagcacagattgttcaaacaggagccaataccaacacaaccagcagtgggcaagggactgtcactgtgacactaccagtggcaggcaatgtggtcaattcaggagggatggtcatgatggttcctggggctggctctgtgcctgctatccaaagaatccctctacctggagcagagatgcttgaagaagagcctctctacgtgaatgccaaacaataccaccgtattcttaagaggaggcaagcccgagctaaactagaggcagaagggaaaattccaaaggagagaaggaaatacctgcatgagtctcggcaccgtcatgccatggcacggaagcgtggtgaaggtggacgatttttctctccaaaggaaaaggatagtccccatatgcaggatccaaaccaagccgatgaagaagcaatgacacagatcatccgagtgtcctaaccccacgccatgtgatggagctgatcaaggtcatgtttctcactgttccaggaaattgatcaactcttccaatgggacattgatgatcacattctgccctttactacaggacagaaaccacttagtttttaataagtggctcagtattacaattgcagcgatgcctggcaaattgaagttgcaagcctttgtcttactctttcagtcaggacctatttcagactgttgatgacattgacatttcatggattcggatgatgcaaggagacacatgccaccccagcagtacacaaagcacttaccttgactggtgaagtcagccagccatctcagcagggaagaacaaccttctcaaccaaaactgcaatcaggaaagcagcagcccactccttcccatggaatctagacagcatttatccctctggtgggggaatctcacactgactaactgaatggacgctttgtattcagagatggcttccaggcaaggaagttctatcttgtgatacggaaacaataaattcctgagatacattcttccaatctgtggtaataataagaattcctctctgcccagatggtaggttgatatttctggactctagccaagaaaaagctaattctggggatagaatgataaaagactcaagcactaaaaatatacattgccgaatctctttttctagctttgaaaagttgtggcctgcttgtccctctgttgactggtcatctggaccatcgtacttgctgtggctacttctaagacaatgtagagggttattaaaccttgaaactgcctttcctaagtagagaacaagactattcaacaacttctttgctgaagcactgaggagatttgtaatactcctaaaggaagggccaaactagagattttcaatcatagactttgtgacagcatttggggaactaaaagattcatgtgtttcagcctagtgggagagagtgggggagaggaagagagagagagagcatgtatacccgtatgttatcatagagcacgattctccagtggatggatacctggaatggatcattaagatgaagagagtaattcacatttactctagaacctttaacaagcactgaaaggaagaagcctgagatttgatccttgacaatttctggaaagcactggtcagtcacactgtcctggacagagtccaagttacccactaaagcttgaggtggatgttggcttcactcctgcagcacaatgctggccctagaaagcgagcattttcattcttcccatggcagctgattctttggtgccagttttcatgttttctccataggccttgtgcagaaaggttttctcattgcatccatactgtgagaataaactgcagactgaaagaaacatgcctgcagggtcaggaactgggccactgttcccagaacgggttgtgcctcagaaatctatttctcttttagatgttgaaccctgagagaactaagatgatatttcagaagagttggctgccttctctggaaacaaggaaaacccaataattccgaggaacattgggggttaaataccaagaataaaaattggttcttctttgacttcagcttaactgtattaagacagaaattaagccctctaaaaacaccacaaagagagatgattgtaatgatagaaatagaggtacagagctatgcaaaggaaacaggaagtgaaatattcctagtcccagggatctggtaatcgctcctggcttccagatgtcaaaggactgatcctttggtaagctcactagaaacttctagctctacaagagtttgggatattaatgttattcagtaagtcccaagtttttcagagaatagattactaacaatgaggaatttatattccttggttaatttaggagtctaagatgcagagttcagaaagaaattactcagacctaactttgagtgcttaagctgccaacagttagaagatgctatttatttgtgtctgtaagtttgtacatagtaatgccagccttgttgctgaattttttatttggggggagatgactttgaattttgtttgaaatgcttcagttgtcattttgtcattgcatttcaaatagctcatgacccttttcttgtggtcactttggcacaccatagtagcccacaaagtgggggcagggtattgacatttggattttttctttgatactagttcttttattcatttttatttgtgactgtagtgataactttacagatggagaaagagtgaatggatgaatgaataattggtttaatgcctagttatgcaacttgagtgctttttttttttttttgcaggataattttaagtgtatatattttaactgcactggtacattgaacatgtcagtgtcgatgccactggaccaacagagcattttgtggctatagggtgcctgataataatgtcttgatttttctttgggattcaactatatcgaaggtttttcccccagcagtatgggggcgtacaggtgatcgatcattaatgtcattgcaattgttattttttaaaataaatttataaaaataaccgaaaagtaatgtgacttttgaggaatctgcaactcctgggttctagtttgtgtttccagtgttgaaattttgatctcccccgacaagacttgtctgcatggacggtgtctctgtaaacagtatcaaacttgtaatgtctgagcctcttagctttatctccccttaatttcttcccttttggcccttccaccctgttgaggagattttttctgtcacctgcaggctgatcatacatttgatgc

SEQ ID NO: 286212 - DNA, 3936 bp, Homo sapiens
tttgctaggcaccggcagtggcggcggcagcggcggctggagcctctgattgggtttcggagtccggtactggagccaatcagcgcgggcagcgaaccgggggagcgaggcacggagtgtacctcacagccttctaggatctccagagtggacaggaatctcacttggagggaccatggagcagtatacagcaaacagcaatagttcgacagagcagattgttgtccaggcaggacagattcagcagcaggtccaagggcagccattaatggtgcaggtcagtggaggccagctaatcacatcaactggccaacccatcatggtccaggctgtccctggtggacaaggtcaaaccatcatgcaagtacctgtttctggaacacagggtttgcagcaaatacagttggtcccacctggacagatccagatccagggtggacaggctgtgcaggtgcagggccagcagggccagacccagcagatcatcatccagcagccccagacggctgtcactgctggccagactcagacacagcagcagattgctgtccagggacagcaagtggcacagactgctgaagggcagaccatcgtctatcaaccagttaatgcagatggcaccattctccagcaagttacagtccctgtttcaggcatgatcactatcccagcagccagtttggcaggagcacagattgttcaaacaggagccaataccaacacaaccagcagtgggcaagggactgtcactgtgacactaccagtggcaggcaatgtggtcaattcaggagggatggtcatgatggttcctggggctggctctgtgcctgctatccaaagaatccctctacctggagcagagatgcttgaagaagagcctctctacgtgaatgccaaacaataccaccgtattcttaagaggaggcaagcccgagctaaactagaggcagaagggaaaattccaaaggagagaaggaaatacctgcatgagtctcggcaccgtcatgccatggcacggaagcgtggtgaaggtggacgatttttctctccaaaggaaaaggatagtccccatatgcaggatccaaaccaagccgatgaagaagcaatgacacagatcatccgagtgtcctaaccccacgccatgtgatggagctgatcaaggtcatgtttctcactgttccaggaaattgatcaactcttccaatgggacattgatgatcacattctgccctttactacaggacagaaaccacttagtttttaataagtggctcagtattacaattgcagcgatgcctggcaaattgaagttgcaagcctttgtcttactctttcagtcaggacctatttcagactgttgatgacattgacatttcatggattcggatgatgcaaggagacacatgccaccccagcagtacacaaagcacttaccttgactggtgaagtcagccagccatctcagcagggaagaacaaccttctcaaccaaaactgcaatcaggaaagcagcagcccactccttcccatggaatctagacagcatttatccctctggtgggggaatctcacactgactaactgaatggacgctttgtattcagagatggcttccaggcaaggaagttctatcttgtgatacggaaacaataaattcctgagatacattcttccaatctgtggtaataataagaattcctctctgcccagatggtaggttgatatttctggactctagccaagaaaaagctaattctggggatagaatgataaaagactcaagcactaaaaatatacattgccgaatctctttttctagctttgaaaagttgtggcctgcttgtccctctgttgactggtcatctggaccatcgtacttgctgtggctacttctaagacaatgtagagggttattaaaccttgaaactgcctttcctaagtagagaacaagactattcaacaacttctttgctgaagcactgaggagatttgtaatactcctaaaggaagggccaaactagagattttcaatcatagactttgtgacagcatttggggaactaaaagattcatgtgtttcagcctagtgggagagagtgggggagaggaagagagagagagagcatgtatacccgtatgttatcatagagcacgattctccagtggatggatacctggaatggatcattaagatgaagagagtaattcacatttactctagaacctttaacaagcactgaaaggaagaagcctgagatttgatccttgacaatttctggaaagcactggtcagtcacactgtcctggacagagtccaagttacccactaaagcttgaggtggatgttggcttcactcctgcagcacaatgctggccctagaaagcgagcattttcattcttcccatggcagctgattctttggtgccagttttcatgttttctccataggccttgtgcagaaaggttttctcattgcatccatactgtgagaataaactgcagactgaaagaaacatgcctgcagggtcaggaactgggccactgttcccagaacgggttgtgcctcagaaatctatttctcttttagatgttgaaccctgagagaactaagatgatatttcagaagagttggctgccttctctggaaacaaggaaaacccaataattccgaggaacattgggggttaaataccaagaataaaaattggttcttctttgacttcagcttaactgtattaagacagaaattaagccctctaaaaacaccacaaagagagatgattgtaatgatagaaatagaggtacagagctatgcaaaggaaacaggaagtgaaatattcctagtcccagggatctggtaatcgctcctggcttccagatgtcaaaggactgatcctttggtaagctcactagaaacttctagctctacaagagtttgggatattaatgttattcagtaagtcccaagtttttcagagaatagattactaacaatgaggaatttatattccttggttaatttaggagtctaagatgcagagttcagaaagaaattactcagacctaactttgagtgcttaagctgccaacagttagaagatgctatttatttgtgtctgtaagtttgtacatagtaatgccagccttgttgctgaattttttatttggggggagatgactttgaattttgtttgaaatgcttcagttgtcattttgtcattgcatttcaaatagctcatgacccttttcttgtggtcactttggcacaccatagtagcccacaaagtgggggcagggtattgacatttggattttttctttgatactagttcttttattcatttttatttgtgactgtagtgataactttacagatggagaaagagtgaatggatgaatgaataattggtttaatgcctagttatgcaacttgagtgctttttttttttttttgcaggataattttaagtgtatatattttaactgcactggtacattgaacatgtcagtgtcgatgccactggaccaacagagcattttgtggctatagggtgcctgataataatgtcttgatttttctttgggattcaactatatcgaaggtttttcccccagcagtatgggggcgtacaggtgatcgatcattaatgtcattgcaattgttattttttaaaataaatttataaaaataaccgaaaagtaatgtgacttttgaggaatctgcaactcctgggttctagtttgtgtttccagtgttgaaattttgatctcccccgacaagacttgtctgcatggacggtgtctctgtaaacagtatcaaacttgtaatgtctgagcctcttagctttatctccccttaatttcttcccttttggcccttccaccctgttgaggagattttttctgtcacctgcaggctgatcatacatttgatgc

SEQ ID NO: 286213 - DNA, 3969 bp, Homo sapiens
tttgctaggcaccggcagtggcggcggcagcggcggctggagcctctgattgggtttcggagtccggtactggagccaatcagcgcgggcagcgaaccgggggagcgaggcacggagtgtacctcacagccttctaggatctccagagtggacaggaatctcacttggagggaccatggagcagtatacagcaaacagcaatagttcgacagagcagattgttgtccaggcaggacagattcagcagcagcagcagggtggtgtcactgctgtgcagttgcagactgaggcccaggtggcatccgcctcaggccagcaagtccagaccctccaggtagtccaagggcagccattaatggtgcaggtcagtggaggccagctaatcacatcaactggccaacccatcatggtccaggctgtccctggtggacaaggtcaaaccatcatgcaagtacctgtttctggaacacagggtttgcagcaaatacagttggtcccacctggacagatccagatccagggtggacaggctgtgcaggtgcagggccagcagggccagacccagcagatcatcatccagcagccccagacggctgtcactgctggccagactcagacacagcagcagattgctgtccagggacagcaagtggcacagactgctgaagggcagaccatcgtctatcaaccagttaatgcagatggcaccattctccagcaagttacagtccctgtttcaggcatgatcactatcccagcagccagtttggcaggagcacagattgttcaaacaggagccaataccaacacaaccagcagtgggcaagggactgtcactgtgacactaccagtggcaggcaatgtggtcaattcaggagggatggtcatgatggttcctggggctggctctgtgcctgctatccaaagaatccctctacctggagcagagatgcttgaagaagagcctctctacgtgaatgccaaacaataccaccgtattcttaagaggaggcaagcccgagctaaactagaggcagaagggaaaattccaaaggagagaaggaaatacctgcatgagtctcggcaccgtcatgccatggcacggaagcgtggtgaaggtggacgatttttctctccaaaggaaaaggatagtccccatatgcaggatccaaaccaagccgatgaagaagcaatgacacagatcatccgagtgtcctaaccccacgccatgtgatggagctgatcaaggtcatgtttctcactgttccaggaaattgatcaactcttccaatgggacattgatgatcacattctgccctttactacaggacagaaaccacttagtttttaataagtggctcagtattacaattgcagcgatgcctggcaaattgaagttgcaagcctttgtcttactctttcagtcaggacctatttcagactgttgatgacattgacatttcatggattcggatgatgcaaggagacacatgccaccccagcagtacacaaagcacttaccttgactggtgaagtcagccagccatctcagcagggaagaacaaccttctcaaccaaaactgcaatcaggaaagcagcagcccactccttcccatggaatctagacagcatttatccctctggtgggggaatctcacactgactaactgaatggacgctttgtattcagagatggcttccaggcaaggaagttctatcttgtgatacggaaacaataaattcctgagatacattcttccaatctgtggtaataataagaattcctctctgcccagatggtaggttgatatttctggactctagccaagaaaaagctaattctggggatagaatgataaaagactcaagcactaaaaatatacattgccgaatctctttttctagctttgaaaagttgtggcctgcttgtccctctgttgactggtcatctggaccatcgtacttgctgtggctacttctaagacaatgtagagggttattaaaccttgaaactgcctttcctaagtagagaacaagactattcaacaacttctttgctgaagcactgaggagatttgtaatactcctaaaggaagggccaaactagagattttcaatcatagactttgtgacagcatttggggaactaaaagattcatgtgtttcagcctagtgggagagagtgggggagaggaagagagagagagagcatgtatacccgtatgttatcatagagcacgattctccagtggatggatacctggaatggatcattaagatgaagagagtaattcacatttactctagaacctttaacaagcactgaaaggaagaagcctgagatttgatccttgacaatttctggaaagcactggtcagtcacactgtcctggacagagtccaagttacccactaaagcttgaggtggatgttggcttcactcctgcagcacaatgctggccctagaaagcgagcattttcattcttcccatggcagctgattctttggtgccagttttcatgttttctccataggccttgtgcagaaaggttttctcattgcatccatactgtgagaataaactgcagactgaaagaaacatgcctgcagggtcaggaactgggccactgttcccagaacgggttgtgcctcagaaatctatttctcttttagatgttgaaccctgagagaactaagatgatatttcagaagagttggctgccttctctggaaacaaggaaaacccaataattccgaggaacattgggggttaaataccaagaataaaaattggttcttctttgacttcagcttaactgtattaagacagaaattaagcccttatgcaaaggaaacaggaagtgaaatattcctagtcccagggatctggtaatcgctcctggcttccagatgtcaaaggactgatcctttggtaagctcactagaaacttctagctctacaagagtttgggatattaatgttattcagtaagtcccaagtttttcagagaatagattactaacaatgaggaatttatattccttggttaatttaggagtctaagatgcagagttcagaaagaaattactcagacctaactttgagtgcttaagctgccaacagttagaagatgctatttatttgtgtctgtaagtttgtacatagtaatgccagccttgttgctgaattttttatttggggggagatgactttgaattttgtttgaaatgcttcagttgtcattttgtcattgcatttcaaatagctcatgacccttttcttgtggtcactttggcacaccatagtagcccacaaagtgggggcagggtattgacatttggattttttctttgatactagttcttttattcatttttatttgtgactgtagtgataactttacagatggagaaagagtgaatggatgaatgaataattggtttaatgcctagttatgcaacttgagtgctttttttttttttttgcaggataattttaagtgtatatattttaactgcactggtacattgaacatgtcagtgtcgatgccactggaccaacagagcattttgtggctatagggtgcctgataataatgtcttgatttttctttgggattcaactatatcgaaggtttttcccccagcagtatgggggcgtacaggtgatcgatcattaatgtcattgcaattgttattttttaaaataaatttataaaaataaccgaaaagtaatgtgacttttgaggaatctgcaactcctgggttctagtttgtgtttccagtgttgaaattttgatctcccccgacaagacttgtctgcatggacggtgtctctgtaaacagtatcaaacttgtaatgtctgagcctcttagctttatctccccttaatttcttcccttttggcccttccaccctgttgaggagattttttctgtcacctgcaggctgatcatacatttgatgc

SEQ ID NO: 286214 - DNA, 4196 bp, Homo sapiens
ggcggccagcggccccggcccggggcctgcgagcgcctcggggcactcccggccgaggcctgcaggggccgccccgcgcggggatggcgcctcggggagcaggcacctcggggctccgaccctcgcagggtgccagggccagttgggaatgcgtccctgttccccgactcaggcccaggttctcaggccccaggcctggggccacgaatggccctacactaggggacacatgcgcgccctgggcctcggcgatttcctcctggtcgttctggccgcaaacttaaacctgcccttgcactctccactctccggcccttgggacaggaagcctccccggggcccgcgccccccgctccccgctcccagcgagccgggagtgtacctcacagccttctaggatctccagagtggacaggaatctcacttggagggaccatggagcagtatacagcaaacagcaatagttcgacagagcagattgttgtccaggcaggacagattcagcagcaggtccaagggcagccattaatggtgcaggtcagtggaggccagctaatcacatcaactggccaacccatcatggtccaggctgtccctggtggacaaggtcaaaccatcatgcaagtacctgtttctggaacacagggtttgcagcaaatacagttggtcccacctggacagatccagatccagggtggacaggctgtgcaggtgcagggccagcagggccagacccagcagatcatcatccagcagccccagacggctgtcactgctggccagactcagacacagcagcagattgctgtccagggacagcaagtggcacagactgctgaagggcagaccatcgtctatcaaccagttaatgcagatggcaccattctccagcaagttacagtccctgtttcaggcatgatcactatcccagcagccagtttggcaggagcacagattgttcaaacaggagccaataccaacacaaccagcagtgggcaagggactgtcactgtgacactaccagtggcaggcaatgtggtcaattcaggagggatggtcatgatggttcctggggctggctctgtgcctgctatccaaagaatccctctacctggagcagagatgcttgaagaagagcctctctacgtgaatgccaaacaataccaccgtattcttaagaggaggcaagcccgagctaaactagaggcagaagggaaaattccaaaggagagaaggaaatacctgcatgagtctcggcaccgtcatgccatggcacggaagcgtggtgaaggtggacgatttttctctccaaaggaaaaggatagtccccatatgcaggatccaaaccaagccgatgaagaagcaatgacacagatcatccgagtgtcctaaccccacgccatgtgatggagctgatcaaggtcatgtttctcactgttccaggaaattgatcaactcttccaatgggacattgatgatcacattctgccctttactacaggacagaaaccacttagtttttaataagtggctcagtattacaattgcagcgatgcctggcaaattgaagttgcaagcctttgtcttactctttcagtcaggacctatttcagactgttgatgacattgacatttcatggattcggatgatgcaaggagacacatgccaccccagcagtacacaaagcacttaccttgactggtgaagtcagccagccatctcagcagggaagaacaaccttctcaaccaaaactgcaatcaggaaagcagcagcccactccttcccatggaatctagacagcatttatccctctggtgggggaatctcacactgactaactgaatggacgctttgtattcagagatggcttccaggcaaggaagttctatcttgtgatacggaaacaataaattcctgagatacattcttccaatctgtggtaataataagaattcctctctgcccagatggtaggttgatatttctggactctagccaagaaaaagctaattctggggatagaatgataaaagactcaagcactaaaaatatacattgccgaatctctttttctagctttgaaaagttgtggcctgcttgtccctctgttgactggtcatctggaccatcgtacttgctgtggctacttctaagacaatgtagagggttattaaaccttgaaactgcctttcctaagtagagaacaagactattcaacaacttctttgctgaagcactgaggagatttgtaatactcctaaaggaagggccaaactagagattttcaatcatagactttgtgacagcatttggggaactaaaagattcatgtgtttcagcctagtgggagagagtgggggagaggaagagagagagagagcatgtatacccgtatgttatcatagagcacgattctccagtggatggatacctggaatggatcattaagatgaagagagtaattcacatttactctagaacctttaacaagcactgaaaggaagaagcctgagatttgatccttgacaatttctggaaagcactggtcagtcacactgtcctggacagagtccaagttacccactaaagcttgaggtggatgttggcttcactcctgcagcacaatgctggccctagaaagcgagcattttcattcttcccatggcagctgattctttggtgccagttttcatgttttctccataggccttgtgcagaaaggttttctcattgcatccatactgtgagaataaactgcagactgaaagaaacatgcctgcagggtcaggaactgggccactgttcccagaacgggttgtgcctcagaaatctatttctcttttagatgttgaaccctgagagaactaagatgatatttcagaagagttggctgccttctctggaaacaaggaaaacccaataattccgaggaacattgggggttaaataccaagaataaaaattggttcttctttgacttcagcttaactgtattaagacagaaattaagccctctaaaaacaccacaaagagagatgattgtaatgatagaaatagaggtacagagctatgcaaaggaaacaggaagtgaaatattcctagtcccagggatctggtaatcgctcctggcttccagatgtcaaaggactgatcctttggtaagctcactagaaacttctagctctacaagagtttgggatattaatgttattcagtaagtcccaagtttttcagagaatagattactaacaatgaggaatttatattccttggttaatttaggagtctaagatgcagagttcagaaagaaattactcagacctaactttgagtgcttaagctgccaacagttagaagatgctatttatttgtgtctgtaagtttgtacatagtaatgccagccttgttgctgaattttttatttggggggagatgactttgaattttgtttgaaatgcttcagttgtcattttgtcattgcatttcaaatagctcatgacccttttcttgtggtcactttggcacaccatagtagcccacaaagtgggggcagggtattgacatttggattttttctttgatactagttcttttattcatttttatttgtgactgtagtgataactttacagatggagaaagagtgaatggatgaatgaataattggtttaatgcctagttatgcaacttgagtgctttttttttttttttgcaggataattttaagtgtatatattttaactgcactggtacattgaacatgtcagtgtcgatgccactggaccaacagagcattttgtggctatagggtgcctgataataatgtcttgatttttctttgggattcaactatatcgaaggtttttcccccagcagtatgggggcgtacaggtgatcgatcattaatgtcattgcaattgttattttttaaaataaatttataaaaataaccgaaaagtaatgtgacttttgaggaatctgcaactcctgggttctagtttgtgtttccagtgttgaaattttgatctcccccgacaagacttgtctgcatggacggtgtctctgtaaacagtatcaaacttgtaatgtctgagcctcttagctttatctccccttaatttcttcccttttggcccttccaccctgttgaggagattttttctgtcacctgcaggctgatcatacatttgatgc

SEQ ID NO: 286215 - DNA, 853 bp, Homo sapiens
ggtgtcaaagcgggaaggtgggcgtggcttcagggaacgcctgcgcgttgctcctccgaaggggtggggcgatccctgaactggagttagtgggcgtggcctcagaggcgcctgcgcggaggcggttggagggaggcccgattcccctttgttcgggttcgccattttgctaggcaccggcagtggcggcggcagcggcggctggagcctctgattgggtttcggagtccggtactggagccaatcagcgcgggcagcgaaccgggggagcgaggcacggtgagtgtgaggagccaatatccagcggcccagagccggccccagcgccccgattggcgggtctcgctgaccactcaggagaggcccaggcgcccgtcgagcccggggagtcgagctgagcctagccgagccgggcggccagcggccccggcccggggcctgcgagcgcctcggggcactcccggccgaggcctgcaggggccgccccgcgcggggatggcgcctcggggagcaggcacctcggggctccgaccctcgcagggtgccagggccagttgggaatgcgtccctgttccccgactcaggcccaggttctcaggccccaggcctggggccacgaatggccctacactaggggacacatgcgcgccctgggcctcggcgatttcctcctggtcgttctggccgcaaacttaaacctgcccttgcactctccactctccggcccttgggacaggaagcctccccggggcccgcgccccccgctccccgctcccagcgagccgggtctgtcttatctgcagcccctctaggtcgggagggaggcctggggagggtgcgcgccgcggccgcg

SEQ ID NO: 286216 - DNA, 2163 bp, Homo sapiens
ttgcaggtgtgtttctcccaccagcatgctttcataccggtccgtggacatccggaagagcttgcagctggaggaactcctggcgagggagcagctggagtacaccatagaggaggaggtggccaagcagaccatccgcatgtggctcaagaagtgcctgaagcgcatcagagctaaacagcagcagtcgtgcagtatcatccacagcctgagagagagtcagcagcaagagctgagccggtttctgaacccgcccagcatcgagaccacccagcccagtgaggacacgaatgccaacagtcaggacaacagcatgcaacctgagacaagcagccagcagcagctcctgagccccacgctgtcggatcgaggaggaagtcggcaagatgcagccgacgcagggaaaccccagaggaaatttgggcagtggcgtctgccctcagccccaaaaccaataagccattcagtgtcctcagtcaacttacggtttggaggaaggacaaccatgaaatctgtcgtgtgcaaaatgaaccccatgactgacgcggcttcctgcggttctgaagttaagaagtggtggacccggcagctgactgtggagagcgacgaaagtggggatgaccttctggatatttaggtggatgtcaatgtagatgaatttctagtggtggaaaccgttttctaataatgtccttgattgtccagtgagcaatctgtaattgatctataactgaattccagcttgtcacaagatgtttataaattgattttcatcctgccacagaaaggcataagctgcatgtatgatgggttactatcaatcattgctcaaaaaaatttttgtataatgacagtactgataatattagaaatgataccgcaagcaaatgtatatcacttaaaaatgtcatatattctgtctgcgtaaactaaggtatatattcatatgtgctctaatgcagtattatcaccgccccgcaaaagagtgctaagcccaaagtggctgatatttagggtacaggggttatagctttagttcacatctttcccatttccactagaaatatttctcttgagagaatttattatttatgattgatctgaaaaggtcagcactgaacttatgctaaaatgatagtagttttacaaactacagattctgaattttaaaaagtatcttctttttctcgtgttatatttttaaatatacacaagacatttggtgaccagaacaagttgatttctgtcctcagttatgttaatgaaactgttgcctccttctaagaaaattgtgtgtgcaagcaccaggcaaagaaatggactcaggatgcttagcggtttaaaacaaacctgtagataaatcacttgagtgacatagttgcgcaaagatgttaagtttcttaagaaaccttttaataactgagtttagcaaaaagaataaaactatatagctcaatttatttaaaaaaatctttttgcatgtgtgatgttatcattggcttcatttcttacccaaggtatgtctgttttgccataaatcagcagagtcatttcattctgggtgatcctgacacaccattgctatgttagatttgaaatgacatctctgttaaaagaatcttctatggaaataatggtgccctgcaaaatcttcctctgaactcacaggttagggatcacacaacttacttaatcgttttttgtttttgttttttttccttatatgtcaatggcccatgtcctccgggaaaattagaaaagcaaaatgattacaaagtgctgttagatttcttgtgctgggccagccaagtagaagtggacttgacttggacctttaactattttattacagattggacatttgctgttcagatgttttttaacagagggattatctcagaatcctgtgacctccaggttgttttataatctatttttctctatttaacattcctcagatagataggcaaataggacattccttctgtgtcacagaagtatcgtggtagtggcagtctacagtttatatgattcattgtaactatgagataaagaacaaccagtcatgtggccaaaaggattagatttgatttgatgttcacttggagtttactttttgtacatacaagataaaataaatattggatttgtaaaataaaaaac

SEQ ID NO: 286217 - DNA, 664 bp, Homo sapiens
ttgcaggtgtgtttctcccaccagcatgctttcataccggtccgtggacatccggaagagcttgcagctggaggaactcctggcgagggagcagctggagtacaccatagaggaggaggtggccaagcagaccatccgcatgtggctcaagaagtgcctgaagcgcatcagagctaaacagcagcagtcgtgcagtatcatccacagcctgagagagagtcagcagcaagagctgagccggtttctgaacccgcccagcatcgagaccacccagcccagtgaggacacgaatgccaacagtcaggacaacagcatgcaacctgagacaagcagccagcagcagctcctgagccccacgctgtcggatcgaggaggaagtcggcaagatgcagccgacgcagggaaaccccagaggaaatttgggcagtggcgtctgccctcagccccaaaaccaataagccattcagtgtcctcagtcaacttacggtttggaggaaggacaaccatgaaatctgtcgtgtgcaaaatgaaccccatgactgacgcggcttcctgcggttctgaagttaagaagtggtggacccggcagctgactgtggagagcgacctagtggggggaacccggtttctaataaggccctgaatgggccaggggcaattgttg

SEQ ID NO: 286218 - DNA, 2108 bp, Homo sapiens
ttgcaggtgtgtttctcccaccagcatgctttcataccggtccgtggacatccggaagagcttgcagctggaggaactcctggcgagggagcagctggagtacaccatagaggaggaggtggccaagcagaccatccgcatgtggctcaagaagtgcctgaagcgcatcagagctaaacagcagcagtcgtgcagtatcatccacagcctgagagagagtcagcagcaagagctgagccggtttctgaacccgcccagcatcgagaccacccagcccagtgaggacacgaatgccaacagtcaggacaacagcatgcaacctgagacaagcagccagcagcagctcctgagccccacgctgtcggatcgaggaggaagtcggcaagatgcagccgacgcagggaaaccccagaggaaatttgggcagtggcgtctgccctcagccccaaaaccaataagccattcagtgtcctcagtcaacttacggtttggaggaaggacaaccatgaaatctgtcgttggtggacccggcagctgactgtggagagcgacgaaagtggggatgaccttctggatatttaggtggatgtcaatgtagatgaatttctagtggtggaaaccgttttctaataatgtccttgattgtccagtgagcaatctgtaattgatctataactgaattccagcttgtcacaagatgtttataaattgattttcatcctgccacagaaaggcataagctgcatgtatgatgggttactatcaatcattgctcaaaaaaatttttgtataatgacagtactgataatattagaaatgataccgcaagcaaatgtatatcacttaaaaatgtcatatattctgtctgcgtaaactaaggtatatattcatatgtgctctaatgcagtattatcaccgccccgcaaaagagtgctaagcccaaagtggctgatatttagggtacaggggttatagctttagttcacatctttcccatttccactagaaatatttctcttgagagaatttattatttatgattgatctgaaaaggtcagcactgaacttatgctaaaatgatagtagttttacaaactacagattctgaattttaaaaagtatcttctttttctcgtgttatatttttaaatatacacaagacatttggtgaccagaacaagttgatttctgtcctcagttatgttaatgaaactgttgcctccttctaagaaaattgtgtgtgcaagcaccaggcaaagaaatggactcaggatgcttagcggtttaaaacaaacctgtagataaatcacttgagtgacatagttgcgcaaagatgttaagtttcttaagaaaccttttaataactgagtttagcaaaaagaataaaactatatagctcaatttatttaaaaaaatctttttgcatgtgtgatgttatcattggcttcatttcttacccaaggtatgtctgttttgccataaatcagcagagtcatttcattctgggtgatcctgacacaccattgctatgttagatttgaaatgacatctctgttaaaagaatcttctatggaaataatggtgccctgcaaaatcttcctctgaactcacaggttagggatcacacaacttacttaatcgttttttgtttttgttttttttccttatatgtcaatggcccatgtcctccgggaaaattagaaaagcaaaatgattacaaagtgctgttagatttcttgtgctgggccagccaagtagaagtggacttgacttggacctttaactattttattacagattggacatttgctgttcagatgttttttaacagagggattatctcagaatcctgtgacctccaggttgttttataatctatttttctctatttaacattcctcagatagataggcaaataggacattccttctgtgtcacagaagtatcgtggtagtggcagtctacagtttatatgattcattgtaactatgagataaagaacaaccagtcatgtggccaaaaggattagatttgatttgatgttcacttggagtttactttttgtacatacaagataaaataaatattggatttgtaaaataaaaaac

SEQ ID NO: 286219 - DNA, 415 bp, Homo sapiens
tctccctaagaaaaagaatgacaaatgttatggcactgtctaaaagcacttaaagaatccagaggaagaatgttccaaaaatccgcagcaagactaaatatttggggtgtgatgtgtgacaatcaagagccttaaaagaagtgtttagtcttcagtacacacttgatatgaggcaaccaaaaaaaatacttgatctaccaacaacatatgttgagcaaacctacgtattttccctgtgaacttacgctgtgtgacttccatctccggaaaataagaaaacttttcattacacatattgccctcacagcaacaaaaatatacttcagggctgtcttttttttctacacaatcagtcctataaataagcagagaaaaaataattaaaatcaatattattatactgaccctacaacaa

SEQ ID NO: 286220 - DNA, 392 bp, Homo sapiens
agtagagacgaggtttcaccatgttggtcaggctggtctcgaacttcagacctcaggtgttctgaatgatgagtaggagtttgccgggtcggcaggaggggaagggtgttggaagcaccagaagcagcataagcgggggctgggaggtgtgagagctggcaggttatttggggttggcaaggggtgggctgtggctggagtgtagggtggaataatgctggaaggaagggtttacaccctgaaagatgtcaccaccaaggaggcccggggggtgggccgtggagggttgctggagcaggggcacagaggagggggcagtggtgcgagtggccccaggcagagagtgaaggcagagcattcagcctcctagtctggatgacaggttgtctggt

SEQ ID NO: 286221 - DNA, 2137 bp, Homo sapiens
  misc_feature (27)..(27): n is a, c, g, or t
  misc_feature (77)..(77): n is a, c, g, or t
  misc_feature (114)..(114): n is a, c, g, or t
  misc_feature (815)..(815): n is a, c, g, or t
atttttagtagagacggggtttcgtcntgttgggtagactggtctcgatctcttgacctcatgatccgctggcctcngcctcccaaagtgctgggattataggcgtgagccacngcacccggcctcacccttccattctttgggcatcctctgcccaaactcctttgcaaccatcagacccaggcaaccgtgtggccagcttcctggacctggtcctgggcaaggacattcagcatggaggtcaggatgaatgtggtcatgccccctgtatcctcctcccccagcagcccccagagatggttcccacagtcaccgagctcctcaatggtcacagtagcgctgggctcagagagggcgccttccccatcggtccggtagctgcagctgtagttgccaggctgatggactggaaaggtggcctccacatcctcctgggcctcaggcacctccagaaactcatggtcgccctcccgcctcagcagaaaagtcacaccccgcagcacacctcggcacactgctgttgttttcaggccgggggtgatccaggacactggcgccatcgagagccagggagcaggcaaggactctgtgggtggggtggagttgaagagtgcttctgcataacaggagacgtgggaagcccagcagaacctgggccccacactcataagactgtgaaggagacagggatggagggcattgctgggaaaaggcaggcaggcaccagtggaaacaaggcatacggcaagagaaaaagagtgtgtgggagctgtacggcatgccgggcctgctggggacacaaccatgtattcctnacaacacagacatcatccccatttgacagatgggaagattggggcttggggctcagagacatcgggtgacttggaggaagggagaccccccagtcaacaacctacccactgcctcctggcccccaattcatgccccggctcacttggccctgtcagctccaggagcttgctcagctgggtccatcctgtggacaagcccgagcggcagcggtagcggccctgggtgtcacccgtcagcaggaactggtgcttgatggcagggacccagaccccaggaggcctcaccccacagcaagagaaagaccacgagcatggacatgatggtcgcgctcactccggtgcagtgagtgtctgggtgttggatcctggaacctgttctagaaggagacgctgagttctccccactctacctggagctgctgaggtcaagtggagagtgccggggctgaagcccagcgagcccctccctgtcacaccacactgcacatgtgacaccaaaggcatttattgagcatctactgtgtgccagatgcaaagaagacagtgggataactgggcaaggagcattccaggcagagggaacagccagtgcaaacatgggagatgcgggtgcagtgagaagcagcagaggagaccaggagttgaggcgactgcagagcgattgcagagctcatagacgtgatgaagaccagctgggcactgcagcggctctggcttctgctgtgagggacggggagctgtggagactccctctgtttggtcccatttccatattgctgagcacctgctgcatgctctctgtcctgctcagagccagtacctggatggaggctgtgtgttctgggtggactgggggagaatgcattctttgcagaagagacaaccaggtgctgaggcctgaagtcataaccagacctggggcactcagacaaggactggtggccaggccagaggagcagagctcagggtgtgcacagaactcagaagtcagaccactgaacagtgacagaacctttcagcccattggcaatgaggctgcccaggcagccagaggcctggtcaaatctgaggtctgcagagatggagctgtcattctgtgtttcctttggcagtcccaacaccagcctcgttgcaccctcctcttagcttccctgggttctccagccctaagggtggtagcagcttcctgcaagtatccaactctgagattctgcaacatccacttttgctctctgagccttgcaaaacctgcacaatcagtccctaacttatatcccctctgtttgaaatacctagtgtggtttctatttcctgacttgact

SEQ ID NO: 286222 - DNA, 458 bp, Homo sapiens
ccacaccccaggccgcgcccgcgcctgcgcctcagccccggcttcatcttccctgtcttgttcctgggcgcagagggctcctccggcgccgccgagctgcgcccgctgccttcacaccccggacatccgcgccacacgtgagtgtccccgcacccctcccccaggaccgtggaagtcccagattcgggcctgctctggggcttctggggtccccagcctcggtcactctgacgggtgaagggaagaagaaatgatggagaaaacggtgctccttcatggagggaccaaaaaaggacatacaatctatgtcaatagatgagggttttccctccataagtttaactttaaaagtgtatttaaggtgccgggcgcagtggctcacacctgtaatctcagcactttgagaggccgaggcaggcggattgcctgagctcaggagttccagaccagcctgggta

SEQ ID NO: 286223 - DNA, 1614 bp, Homo sapiens
ccacaccccaggccgcgcccgcgcctgcgcctcagccccggcttcatcttccctgtcttgttcctgggcgcagagggctcctccggcgccgccgagctgcgcccgctgccttcacaccccggacatccgcgccacactgttggatcctggaacctgttctagaaggagacgctgagttctccccactctacctggagctgctgaggtcaagtggagagtgccggggctgaagcccagcgagcccctccctgtcacaccacactgcacatgtgacaccaaaggtggggttcacctcttttcagactttctgcggttgccctcacatgggctgtctggaggtgcaccctcactcttcctgaggactgtggttccttctccatcactggttcattctgcatggtgtgacccaccacggctctggagtcggatttccacccaggtcattcagctgagacctgcgcttcccaggcctacccgtgacatgtgctcagttacctgagctgctggtggtcactcatgtggctatagcctgctgcctggaggccaggcctcccgcttcccctgcctccccctctcctcaccacagcctgttgggatggaacaggacaggggtgagaccgtggtgctttcacactcagcctccatggacatcctgtcattcccacccggggaggtctggtccccaccctgggtgtcccagcctagctccgctacgagtgtgagggcccagggcaaccgcctagccctcatctgccccctgcactgcatcctccccactcattcattccacaggcatttattgagcatctactgtgtgccagatgcaaagaagacagtgggataactgggcaaggagcattccaggcagagggaacagccagtgcaaacatgggagatgcgggtgcagtgagaagcagcagaggagaccaggagttgaggcgactgcagagcgattgcagagctcatagacgtgatgaagaccagctgggcactgcagcggctctggcttctgctgtgagggacggggagctgtggagactccctctgtttggtcccatttccatattgctgagcacctgctgcatgctctctgtcctgctcagagccagtacctggatggaggctgtgtgttctgggtggactgggggagaatgcattctttgcagaagagacaaccaggtgctgaggcctgaagtcataaccagacctggggcactcagacaaggactggtggccaggccagaggagcagagctcagggtgtgcacagaactcagaagtcagaccactgaacagtgacagaacctttcagcccattggcaatgaggctgcccaggcagccagaggcctggtcaaatctgaggtctgcagagatggagctgtcattctgtgtttcctttggcagtcccaacaccagcctcgttgcaccctcctcttagcttccctgggttctccagccctaagggtggtagcagcttcctgcaagtatccaactctgagattctgcaacatccacttttgctctctgagccttgcaaaacctgcacaatcagtccctaacttatatcccctctgtttgaaatacctagtgtggtttctatttcctgacttgact

SEQ ID NO: 286224 - DNA, 1710 bp, Homo sapiens
ccacaccccaggccgcgcccgcgcctgcgcctcagccccggcttcatcttccctgtcttgttcctgggcgcagagggctcctccggcgccgccgagctgcgcccgctgccttcacaccccggacatccgcgccacacggacccagaccccaggaggcctcaccccacagcaagagaaagaccacgagcatggacatgatggtcgcgctcactccggtgcagtgagtgtctgggtgttggatcctggaacctgttctagaaggagacgctgagttctccccactctacctggagctgctgaggtcaagtggagagtgccggggctgaagcccagcgagcccctccctgtcacaccacactgcacatgtgacaccaaaggtggggttcacctcttttcagactttctgcggttgccctcacatgggctgtctggaggtgcaccctcactcttcctgaggactgtggttccttctccatcactggttcattctgcatggtgtgacccaccacggctctggagtcggatttccacccaggtcattcagctgagacctgcgcttcccaggcctacccgtgacatgtgctcagttacctgagctgctggtggtcactcatgtggctatagcctgctgcctggaggccaggcctcccgcttcccctgcctccccctctcctcaccacagcctgttgggatggaacaggacaggggtgagaccgtggtgctttcacactcagcctccatggacatcctgtcattcccacccggggaggtctggtccccaccctgggtgtcccagcctagctccgctacgagtgtgagggcccagggcaaccgcctagccctcatctgccccctgcactgcatcctccccactcattcattccacaggcatttattgagcatctactgtgtgccagatgcaaagaagacagtgggataactgggcaaggagcattccaggcagagggaacagccagtgcaaacatgggagatgcgggtgcagtgagaagcagcagaggagaccaggagttgaggcgactgcagagcgattgcagagctcatagacgtgatgaagaccagctgggcactgcagcggctctggcttctgctgtgagggacggggagctgtggagactccctctgtttggtcccatttccatattgctgagcacctgctgcatgctctctgtcctgctcagagccagtacctggatggaggctgtgtgttctgggtggactgggggagaatgcattctttgcagaagagacaaccaggtgctgaggcctgaagtcataaccagacctggggcactcagacaaggactggtggccaggccagaggagcagagctcagggtgtgcacagaactcagaagtcagaccactgaacagtgacagaacctttcagcccattggcaatgaggctgcccaggcagccagaggcctggtcaaatctgaggtctgcagagatggagctgtcattctgtgtttcctttggcagtcccaacaccagcctcgttgcaccctcctcttagcttccctgggttctccagccctaagggtggtagcagcttcctgcaagtatccaactctgagattctgcaacatccacttttgctctctgagccttgcaaaacctgcacaatcagtccctaacttatatcccctctgtttgaaatacctagtgtggtttctatttcctgacttgact

SEQ ID NO: 286225 - DNA, 900 bp, Homo sapiens
agctgggcactgcagcggctctggcttctgctgtgagggacggggagctgtggagactccctctgtttggtcccatttgcatttattgagcatctactgtgtgccagatgcaaagaagacagtgggataactgggcaaggagcattccaggcagagggaacagccagtgcaaacatgggagatgcgggtgcagtgagaagcagcagaggagaccaggagttgaggcgactgcagagcgattgcagagctcatagacgtgatgaagaccagctgggcactgcagcggctctggcttctgctgtgagggacggggagctgtggagactccctctgtttggtcccatttccatattgctgagcacctgctgcatgctctctgtcctgctcagagccagtacctggatggaggctgtgtgttctgggtggactgggggagaatgcattctttgcagaagagacaaccaggtgctgaggcctgaagtcataaccagacctggggcactcagacaaggactggtggccaggccagaggagcagagctcagggtgtgcacagaactcagaagtcagaccactgaacagtgacagaacctttcagcccattggcaatgaggctgcccaggcagccagaggcctggtcaaatctgaggtctgcagagatggagctgtcattctgtgtttcctttggcagtcccaacaccagcctcgttgcaccctcctcttagcttccctgggttctccagccctaagggtggtagcagcttcctgcaagtatccaactctgagattctgcaacatccacttttgctctctgagccttgcaaaacctgcacaatcagtccctaacttatatcccctctgtttgaaatacctagtgtggtttctatttcctgacttgact

SEQ ID NO: 286226 - DNA, 792 bp, Homo sapiens
taatattgtactattaaaatccatctgttgtttaatgttcaaaaatcaatccagataatatgaaatccattgagctatttctaaaaagtgattgttaatttcagtaacatgccattttgatttttagtggattatcttgatggatctctgcctaaaagcataagatcaacggaaccatgtcatctgaatagaagctagtgaatgggattgggtgcagtaaaatggaaatcctttttaatgaaagataagagctgcatccttacctctcaacctttcaatcctttcatttgaggatttaggaggaaccatctggattgtaacagcaagttcttttcaagcacaaaagttccaggagagagagaatatagatttagtattattcctcctggcattcctcattctaacttttgccatcacctgagttccagcattggggaagacaaaagcaccagggtgcacatctttaaagacatttatgctgcttgccttcaagtaaatatcagctacaaccaggaatattagactgtctcccttttccctgtaaagtgggcctttaatgggatggccacactttattgatgggaatcctgtgttcaagttgagatcacaggtacaaatgaagcctaactagtaacctacaaaatatatgcactagaagctatggcagtggttcaaagttagaaagatgattagtatattcatttttatcgactgtagcactttatgatgcttatggaaatattcttagtaaattattcaatcaaataaattttacatgagggttttactaaa

SEQ ID NO: 286227 - DNA, 2048 bp, Homo sapiens
ggccggacgcgcggtggcctgacggtcgcaaggattacattcgcctgacccggcccggcttgaccctgcccgggcgcgccatgttcgcgcgtgggtcccggaggcgccgctccgggcgtgcgcctccagaggcagaggacccagaccggggccagccctgcaactcctgtagggagcagtgccctggcttcctgctccacggctggagaaagatctgccagcattgcaaatgcccgcgggaggagcatgcagtgcacgcggtgcctgtggacctggaacgcatcatgtgtcggctaatctcggacttccagcgccactccatctccgacgacgactcaggctgtgcatcggaggagtatgcctgggtgcccccaggccttaagccggagcaggtatatcaatttttcagctgcctcccagaggacaaggtcccctacgtcaacagtcctggggagaaatacaggatcaagcagctgctgcaccagctgcccccacacgacagtgaggcacagtactgcacagcactggaagaggaggaaaagaaagagctccgagcctttagccagcagcggaagcgggagaatctggggcgtggcatcgtgcgcatcttcccggtgaccatcactggggccatctgtgaggagtgcggaaagcagattggaggtggggacatcgcagtgtttgccagccgtgcaggcctgggtgcctgctggcacccacagtgcttcgtgtgtaccacgtgccaggaactgctggttgacctcatctacttctaccatgttggcaaggtctactgcgggcgtcaccatgccgaatgcctgcgtccacgctgccaagcctgtgacgagatcatcttctcccctgagtgcacggaggctgagggccgccactggcacatggatcacttctgctgctttgagtgtgaagcttcactaggagggcagcgctatgtcatgcgtcagagccgcccccactgctgcgcctgctacgaggcccgccacgcggagtactgtgatggctgtggggagcacatcggcctggaccaaggccagatggcttacgagggccagcactggcatgcctcagaccgctgcttctgctgtagtcgctgtgggcgggccctgctgggccgcccattcctgccacgccgaggcctaatcttctgctctcgagcctgcagccttgggtccgagcccacagctccagggccgagccgccgcagctggagtgccggccctgtcacagccccacttgcagcctccacagcctctttctctgctgtgaagggggcatcagagaccaccaccaaaggcaccagcacagagttagcgccagctacaggccctgaggagccctcccgctttctgagaggggctccccaccgccactccatgccggaactggggctccgcagtgtccccgagccgcccccagagtcccccggccagcctaacctgcgcccagatgatagtgccttcggtcgtcagagcaccccacgcgtcagcttccgcgaccctctggtgtctgaaggaggcccgcgccggaccctgagtgcacccccggcccagcgccgcaggccacgcagtcccccacccagggcccccagccgtcgccgccaccatcatcataatcaccatcaccatcacaaccgccacccaagcagacgtcgccactatcaatgtgacgcgggatcagggtcagactcggaatcttgctccagctcgccctccagttccagttccgaatcatcagaggatgatggcttcttcctaggagagcgcatccctctgcccccgcatttgtgcaggcccatgcctgctcaggacactgcaatggagaccttcaactccccatctttatcgctccccagggactctcgcgcagggatgcctcgtcaggcccgagacaagaactgcatcgtggcttgaaggcaggccgtcctggagggggctccattctccagtcagagtagatgatgaggcccatgcccctcacccccacgccccgcccctacaacctaagtcataaatcctcttcctccctccttt

SEQ ID NO: 286228 - DNA, 2129 bp, Homo sapiens
ggccggacgcgcggtggcctgacggtcgcaaggattacattcgcctgacccggcccggcttgaccctgcccgggcgcgccatgttcgcgcgtgggtcccggaggcgccgctccgggcgtgcgcctccagaggcagaggacccagaccggggccagccctgcaactcctgtagggagcagtgccctggcttcctgctccacggctggagaaagatctgccagcattgcaaatgcccgcgggaggagcatgcagtgcacgcggtgcctgtggacctggaacgcatcatgtgtcggctaatctcggacttccagcgccactccatctccgacgacgactcaggctgtgcatcggaggagtatgcctgggtgcccccaggccttaagccggagcaggtatatcaatttttcagctgcctcccagaggacaaggtcccctacgtcaacagtcctggggagaaatacaggatcaagcagctgctgcaccagctgcccccacacgacagtgaggcacagtactgcacagcactggaagaggaggaaaagaaagagctccgagcctttagccagcagcggaagcgggagaatctggggcgtggcatcgtgcgcatcttcccggtgaccatcactggggccatctgtgaggagtgcggaaagcagattggaggtggggacatcgcagtgtttgccagccgtgcaggcctgggtgcctgctggcacccacagtgcttcgtgtgtaccacgtgccaggaactgctggttgacctcatctacttctaccatgttggcaaggtctactgcgggcgtcaccatgccgaatgcctgcgtccacgctgccaagcctgtgacgagatcatcttctcccctgagtgcacggaggctgagggccgccactggcacatggatcacttctgctgctttgagtgtgaagcttcactaggagggcagcgctatgtcatgcgtcagagccgcccccactgctgcgcctgctacgaggcccgccacgcggagtactgtgatggctgtggggagcacatcggcctggaccaaggccagatggcttacgagggccagcactggcatgcctcagaccgctgcttctgctgtagtcgctgtgggcgggccctgctgggccgcccattcctgccacgccgaggcctaatcttctgctctcgagcctgcagccttgggtccgagcccacagctccagggccgagccgccgcagctggagtgccggccctgtcacagccccacttgcagcctccacagcctctttctctgctgtgaagggggcatcagagaccaccaccaaaggcaccagcacagagttagcgccagctacaggccctgaggagccctcccgctttctgagaggggctccccaccgccactccatgccggaactggggctccgcagtgtccccgagccgcccccagagtcccccggccagcctaacctgcgcccagatgatagtgccttcggtcgtcagagcaccccacgcgtcagcttccgcgaccctctggtgtctgaaggaggcccgcgccggaccctgagtgcacccccggcccagcgccgcaggccacgcagtcccccacccagggcccccagccgtcgccgccaccatcatcataatcaccatcaccatcacaaccgccacccaagcagacgtcgccactatcaatgtgacgcgggatcagggtcagactcggaatcttgctccagctcgccctccagttccagttccgaatcatcagaggatgatggcttcttcctaggagagcgcatccctctgcccccgcatttgtgcaggcccatgcctgctcaggacactgcaatggagaccttcaactccccatctttatcgctccccagggactctcgcgcagggatgcctcgtcaggcccgagacaagaactgcatcgtggcttgaaggcaggccgtcctggagggggctccattctccagtcagagtagatgatgaggcccatgcccctcacccccacgccccgcccctacaacctaagtcataaatcctcttcctccctcctttatcagtttgtttctatttttgtttctgttttagagacttggtctaccctattgcccaggctggagtgcagtggtgtgatca

SEQ ID NO: 286229 - DNA, 437 bp, Homo sapiens
agccaccccctaatgtctaagcctggcccgaatcttagagtccaatgcccaccccgctctgggagagagcaccctgggaaagaaagggaggagtgagagagaggttcaccagccagtctccaggagagaaccaaaacctgtttcctgctttctccaaaagggccccattctggaggagggaggaaggcacccaggggtgccctgcctcggattccccacctcttcttgagaagggactcgttcacgaggggtggggttacgcctgggggttctgcctcagtttttccccctcgtcgttccccacaggcctggaccaaggccagatggcttacgagggccagcactggcatgcctcagaccgctgcttctgctgtagtcgctgtgggcgggccctgctgggccgcccattcctgccacgccgaggcctaatcttctgc

SEQ ID NO: 286230 - DNA, 764 bp, Homo sapiens
ctggatctcactggatccttcactgctaaaggacccccaccgcggattctaagatccttagcacccacctggaggactgggggttttaggtgtccaagaagaaagctcagacctgccgaccgcaggtaccttacctgggatttactatccgacaggggtccgaacgcagctcgggatcagaaaaaaagcaggggtccgaacgcagcccgggatcagaaagaaagcaggtcgtttgcaatctaccggagcctaagggcagaaggcaggaccgtgggaacaatatgccagggggatttccactttctgccatatatgtagtcacatcacccactctgccttggaatattattaaggaccatctaacacgagggtgtatacgtcctgcaatactacgagtaatatcaacttcttggcctctgaatatgaggaagaatatcacagggtgggtgtacacctcgtgctctattatgcggagtcatatctgtctattatggggagtaatatcattctctccctttcaggatattaataacaatttcacaggctgggtgaacacagccggcaatgctgaaattattatcaacctctccccatcttcccctcctggctcttaggacccccatcgcagggggctgaggcatcccccgcgaggcggggactgagtgccagcccctcttccctagccccttcgtcagggctgagagaattttgagcgctagccgtctctcgatcgctggctaataaagaactcctgaattagtaaa

SEQ ID NO: 286231 - DNA, 978 bp, Homo sapiens
ctggatctcactggatccttcactgctaaaggacccccaccgcggattctaagatccttagcacccacctggaggactgggggttttaggtgtccaagaagaaagctcagacctgccgaccgcaggtaccttacctgggatttactatccgacaggggtccgaacgcagctcgggatcagaaaaaaagcaggggtccgaacgcagcccgggatcagaaagaaagcaggtcgtttgcaatctaccggagcctaagggcagaaggcaggaccgtgggaacaatatgccagggggatttccactttctgccatatatgtagtcacatcacccactctgccttggaatattattaaggaccatctaacacgagggtgtatacgtcctgcaatactacgagtaatatcaacttcttggcctctgaatatgaggaagaatatcacagggggtccgaatgcagcccgggatcacaaagaaagcaggtcgtttgcaatctaccagagcctaagggcagaaggcaggatcgtgggaacaatatcccatgggggtgtaccctttctgccatatatgtagtcacatcacccactccgccttggaatattattaaggaccatctaacacgagggtgtatacgtcctgtgatattgggagtaatatcaacttctcggcctctgaatatgaggaagaatatcacaggtcttagaatctcaagtgactctgactctacagtctattgaatgtgcattcagctgcctgaaatcagaaatgacgggaatccatacagtggaattgagcccagcttcaaagaacatcccaacaacatatgcagtgagtgaaatgtcctcttcatctccaccctgaaaacaaaggaacaatgagtcattcgggacagcagagcacaaaatagcaagtattcttttgaagtaaaactaggtatgaaaaaaatactggaacaaataccattattcataaaaacacccga

SEQ ID NO: 286232 - DNA, 685 bp, Homo sapiens
ctggatctcactggatccttcactgctaaaggacccccaccgcggattctaagatccttagcacccacctggaggactgggggttttaggtgtccaagaagaaagctcagacctgccgaccgcaggtaccttacctgggatttactatccgacaggggtccgaacgcagctcgggatcagaaaaaaagcaggggtccgaacgcagcccgggatcagaaagaaagcaggtcgtttgcaatctaccggagcctaagggcagaaggcaggaccgtgggaacaatatgccagggggatttccactttctgccatatatgtagtcacatcacccactctgccttggaatattattaaggaccatctaacacgagggtgtatacgtcctgcaatactacgagtaatatcaacttcttggcctctgaatatgaggaagaatatcacagggatattaataacaatttcacaggctgggtgaacacagccggcaatgctgaaattattatcaacctctccccatcttcccctcctggctcttaggacccccatcgcagggggctgaggcatcccccgcgaggcggggactgagtgccagcccctcttccctagccccttcgtcagggctgagagaattttgagcgctagccgtctctcgatcgctggctaataaagaactcctgaattagtaaa

SEQ ID NO: 286233 - DNA, 663 bp, Homo sapiens
ctggatctcactggatccttcactgctaaaggacccccaccgcggattctaagatccttagcacccacctggaggactgggggttttaggtgtccaagaagaaagctcagacctgccgaccgcaggtaccttacctgggatttactatccgacaggggtccgaacgcagctcgggatcagaaaaaaagcaggggtccgaacgcagcccgggatcagaaagaaagcaggtcgtttgcaatctaccggagcctaagggcagaaggcaggaccgtgggaacaatatgccagggggatttccactttctgccatatatgtagtcacatcacccactctgccttggaatattattaaggaccatctaacacgagggtgtatacgtcctgcaatactacgagtaatatcaacttcttggcctctgaatatgaggaagaatatcacagggctgggtgaacacagccggcaatgctgaaattattatcaacctctccccatcttcccctcctggctcttaggacccccatcgcagggggctgaggcatcccccgcgaggcggggactgagtgccagcccctcttccctagccccttcgtcagggctgagagaattttgagcgctagccgtctctcgatcgctggctaataaagaactcctgaattagtaaa

SEQ ID NO: 286234 - DNA, 848 bp, Homo sapiens
ggctttggcacattattcatacttgtaagatttctctccaatgagttatcttatctgtggtgaggtgcgaggaccgattaaaggctttgccaaatttttcccatttgtagggttgctctccagtatgaattctcttatgtttagttagggttgaggaccagaaaaatgctttgccacattcttcacatttgtagggttttactccagtatgaattaccttatgtttagtaaaagttgaagaccggttaaaagatttgccacattcttcacatttatagggtttctctccagtatgaattctcttatggttagtaaggattgaagactgcttaaaggctttgccacatttttcacatttgtagggtttctcttcagtatgaattatcttatgtttagtaagagttgaggaccagttaaaggctttgccacattcttcacatttgtagggtttctctccagtatgaattatcttatgtgtagtaagggttgaggattggctaaaagatttgccacattcttcacatttgtagggtttctctccagtatgaattatcttatgtgtagtaagatttgaagatcgattaaaacctttgccgcattcttcacatttgtagagtttctctccaacatgaattattttatgtgtagtaagagttgagagttgcttaaaagctttgccacattctaagcatttgtagcgtttctctccagtatgaattatcttatgtgtagtaagggttgaggactggctaaaagctttgccacattcttcacatttgtagggtttctctccagtgtgcatcctcttatgtctagttagtgttgaggaccatataaatgctttgcca

SEQ ID NO: 286235 - DNA, 465 bp, Homo sapiens
ggcatttgttcatttaaacgggctcctaggacgagaacccggggacgccaggcctcgcgggccggcctgggccacaggtgtccccggcgcggaggtcgcagcgccccggacccctctcacctttcgggtctgcggcgcccggggtctcccttcctctgcggctgcggcggctccggggcttcccagggcgcgggcccaggaggcgcggctgcgtcccagaagtgctactgtgacccctgaagcctttcttcccagagtggagaggatggggccaaattctaggaccttccacaaatctttattgagcaaagccctgttctgaacccgggacaactatggatgcagaggaagcctggtaaacaagcagacacaggatggtttgtggaacagcatagcccttcctctcttcgaccttcgctcttgacttctgcagacctctttcagaataaacaaaccctcaaacca

SEQ ID NO: 286236 - DNA, 529 bp, Homo sapiens
tccattttggacatggtaaatttgagatggctataattcatccaagtgtagatgtctagttgcagttgaatatatgagtctgaaatatggggagaggattgggctggagatgctctgtgggagtagagaaaggaggaaagtagaatggagaagaggccttaggcagagtccctagggaattctaacttttagagctaagactcaagaggattaagaagtgatgagtgagtagaaggaaaaagaagagggtgggggtgacaagacatcaacctccaacccacagaagtgctactgtgacccctgaagcctttcttcccagagtggagaggatggggccaaattctaggaccttccacaaatctttattgagcaaagccctgttctgaacccgggacaactatggatgcagaggaagcctggtaaacaagcagacacaggatggtttgtggaacagcatagcccttcctctcttcgaccttcgctcttgacttctgcagacctctttcagaataaacaaaccctcaaacca

SEQ ID NO: 286237 - DNA, 489 bp, Homo sapiens
cgctgagctggcgggcgggcagcccatctggcggcccccgcggggcggcgcggggaggcggcccagacttgctggagccaggcgccggcccgggggcccccctgcccgcctggagaacccagtcttgcccgtgtttggggtgactcagcttccctgcttgtgcaagaacagctgaactctgacctcctgaatggccgactcttgccttgctcctcagggaccccagacacgatcgtaggaaccggagattttatggaaagaagctgatattatttggagaatgaaaaaagaaagatgcacctagacaaaggcacatcaggccactgtgcagaagaacaagcatgctctagaagtgtatgtgctgctgtggaaacacctctaagaaataccgtagaaacccaatgtgcagaatgctccaagaatgccaccgtctgtgcaagaaaaagtatacacacatcagtgcacaggtgtctgaatgtctgtgtaaca

SEQ ID NO: 286238 - DNA, 284 bp, Homo sapiens
agagcagaactgtcttgtttttacctatttttgcacttccagattttatggaaagaagctgatattatttggagaatgaaaaaagaaagatgcacctagacaaaggcacatcaggccactgtgcagaagaacaagcatgctctagaagtgtatgtgctgctgtggaaacacctctaagaaataccgtagaaacccaatgtgcagaatgctccaagaatgccaccgtctgtgcaagaaaaagtatacacacatcagtgcacaggtgtctgaatgtctgtgtaaca

SEQ ID NO: 286239 - DNA, 604 bp, Homo sapiens
cccacgcgtccgcggacgcgtgggcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttca

SEQ ID NO: 286240 - DNA, 291 bp, Homo sapiens
ctcgaattcaagcttctaacgatgtacggggacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttca

SEQ ID NO: 286241 - DNA, 779 bp, Homo sapiens
ctcgaattcaagcttctaacgatgtacggggacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcaaaaaaaaatcttatcaaacacaacctacacagcaccctcacatcagtcatacacaacactatacttttctcactcgacagtaaaacacagaacaaaaaatatttactctgaccagtccctacaacgctggaatacttgtttctattcgtagtgtcgcacgcctatgacttgctactcggtctatgtgctaacacatgaggagcaggcacgcgcgggcaggactcatacacatcatcagtcgtggtcgtctcagcggggtataacagtcatcactagtttacaacaagcgcggctcgagtactcttaaaacttgttattccattctcactcccataatatttcttattttgttttctacttaaatcttatcttctcatgtagtgctacctaatcttatattgattcgatatcttacaatctaatatctacctcctcccgattacgtcctgttaatattttagatcaccgattagcttactccttcctcc

SEQ ID NO: 286242 - DNA, 332 bp, Homo sapiens
tctccaccccaggcgtccgctctatttaaagactccctgcaccgtgtcccacagagggcgccggcaagggtgggacgcgacctgggtgacacggtgcagggagtctttaaatagaggaggggctggagcggggaaacgcgccggggccctagcgcaccatgtattccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttca

SEQ ID NO: 286243 - DNA, 486 bp, Homo sapiens
tacacgtaacagcgcctaaacaggtgtcgggcacatagtgctcagaaaatgttggctcctattaaagtttgacccctttgcttcattcccacccccaggaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttca

SEQ ID NO: 286244 - DNA, 505 bp, Homo sapiens
tacacgtaacagcgcctaaacaggtgtcgggcacatagtgctcagaaaatgttggctcctattaaagtttgacccctttgcttcattcccacccccaggaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttcccgttccctcgccagatcatttattgtgcaacgttcggcgggttcagtttttgaaataagagcttttgctatgctc

SEQ ID NO: 286245 - DNA, 448 bp, Homo sapiens
ccaggccaacctggccaacaaggattcagccggatcaacatctaccacaacactgccaaccacacttcagagttgttggagtccagttgcaggatcagcaggttgtgatccattattccattgttaaaaggcttaaggacaatcaggccacgccaaccttcccccagtggggaaaagcccgccaggtttacggctttaactttgcaagtaaagaagaggcaaccacgttctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcaaaaaaaaaaa

SEQ ID NO: 286246 - DNA, 1770 bp, Homo sapiens
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcagccctgtgtctgtgcttgagtgggggcgagcacggggctgagactagaggtcggcctctgcctggaaagtcccgatctctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggtcggagagatcttctcggcggccggcgccgccttcacgaagctcggggagctgacgatgcagctgcatcccgtggccgactcttctcctgcgggcgcgaagtggacggagacggaaatagagatgctgagggctgctgtgaagcgatttggggacgatcttaatcacatcagctgtgtcatcaaggaacggacagtggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgatgtgacactcagtgctctgaacgactccgatgccaacagtgacgtggtggatattgaagggctaggagaaactcctccagctaagaaactcaacttcgaccaggcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcaaaaaaaaaaa

SEQ ID NO: 286247 - DNA, 661 bp, Homo sapiens
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttca

SEQ ID NO: 286248 - DNA, 1728 bp, Homo sapiens
caaaggacacatacttgcctccaccgagtcctacgatggcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcagccctgtgtctgtgcttgagtgggggcgagcacggggctgagactagaggtcggcctctgcctggaaagtcccgatctctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggtcggagagatcttctcggcggccggcgccgccttcacgaagctcggggagctgacgatgcagctgcatcccgtggccgactcttctcctgcgggcgcgaagtggacggagacggaaatagagatgctgagggctgctgtgaagcgatttggggacgatcttaatcacatcagctgtgtcatcaaggaacggacagtggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgatgtgacactcagtgctctgaacgactccgatgccaacagtgacgtggtggatattgaagggctaggagaaactcctccagctaagaaactcaacttcgaccaggcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcaaaaaaaaaaa

SEQ ID NO: 286249 - DNA, 1953 bp, Homo sapiens
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcagccctgtgtctgtgcttgagtgggggcgagcacggggctgagactagaggtcggcctctgcctggaaagtcccgatctctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggttcgacctccctcgcggacagcgctccctggcggccacgggagggcgggccccccacttggctcgcggctcttccgccccgggcggggggcgggcgggagccgagcctggggtggggctaggggctccgggcgggacggggagggcgggcgccggccccccgtgacgctgccccgcccccaggtcggagagatcttctcggcggccggcgccgccttcacgaagctcggggagctgacgatgcagctgcatcccgtggccgactcttctcctgcgggcgcgaagtggacggagacggaaatagagatgctgagggctgctgtgaagcgatttggggacgatcttaatcacatcagctgtgtcatcaaggaacggacagtggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgatgtgacactcagtgctctgaacgactccgatgccaacagtgacgtggtggatattgaagggctaggagaaactcctccagctaagaaactcaacttcgaccaggcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcaaaaaaaaaaa

SEQ ID NO: 286250 - DNA, 2618 bp, Homo sapiens
cccacgcgtccgcggacgcgtgggcccgcttgcacctcggcgatccccgactcccttctttatggcgtcgctcctgtgctgtgggccgaagctggccgcctgcggcatcgtcctcagcgcctggggagtgatcatgttggtgaggggactccccggcaaggatcggagagggcctgaggggctccgggctgggagggctgggaggcgaggaaactctgggccgcaggcaggccggaggggccggggatctacaggccccggagaaggagacagactgaaattgaaaaatgggaactgttcgagaccagcctgaccaacatggtgaaaccccgtctccaataaaaatacaaaaattagccgggcgtggtggcgcccgcctgtaatcccagctactcaggaggctgaggcaggagaatcgcttgaatccgggaggcggagggtgcagtgagccgagatcgcgccactgcactccagcctgggtgacagagcgagactccgtccccaaagaaaaagaaaaaagggaactggagcggagggccctggagtgggaggagccagggctggtaaaggtggagacccctcaaggtaggagaaacaagagcggggttcctgagaggtgcttgagttgaatggaggacatgggaggaaaagagagtgcttgttccagaaatgtgtagctgggccttgttttcccaggtaatccacccaccgccacttcaagaagaaatgatatgaagaagtgccggttctccctcccctcttccgcactgtcccgtgatgatgacgcctccagagaggacgataatctgggttcctgggagagatggcttggtcactattcccacccttgcctcgaccacttgtctcaatgtcaccacctcacgccctgttccaggtggctgagtccgaatccagtaaccaccacctcgttttggttaatctcaggctcgggtgttgtagcaacattggaaatgggaggggtttacgaagtgaacatgaggtcaggtgcctgaattcaacagtctacccattccccttttccagataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcagccctgtgtctgtgcttgagtgggggcgagcacggggctgagactagaggtcggcctctgcctggaaagtcccgatctctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggtcggagagatcttctcggcggccggcgccgccttcacgaagctcggggagctgacgatgcagctgcatcccgtggccgactcttctcctgcgggcgcgaagtggacggagacggaaatagagatgctgagggctgctgtgaagcgatttggggacgatcttaatcacatcagctgtgtcatcaaggaacggacagtggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgatgtgacactcagtgctctgaacgactccgatgccaacagtgacgtggtggatattgaagggctaggagaaactcctccagctaagaaactcaacttcgaccaggcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcaaaaaaaaaaa

SEQ ID NO: 286251 - DNA, 1667 bp, Homo sapiens
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcagccctgtgtctgtgcttgagtgggggcgagcacggggctgagactagaggtcggcctctgcctggaaagtcccgatctctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggtcggagagatcttctcggcggccggcgccgccttcacgaagctcggggagctgacgatgcagctgcatcccgtggccgactcttctcctgcggggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgatgtgacactcagtgctctgaacgactccgatgccaacagtgacgtggtggatattgaagggctaggagaaactcctccagctaagaaactcaacttcgaccaggcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcaaaaaaaaaaa

SEQ ID NO: 286252 - DNA, 2469 bp, Homo sapiens
cccacgcgtccgcggacgcgtgggcccgcttgcacctcggcgatccccgactcccttctttatggcgtcgctcctgtgctgtgggccgaagctggccgcctgcggcatcgtcctcagcgcctggggagtgatcatgttggtgaggggactccccggcaaggatcggagagggcctgaggggctccgggctgggagggctgggaggcgaggaaactctgggccgcaggcaggccggaggggccggggatctacaggccccggagaaggagacagactgaaattgaaaaatgggaactgttcgagaccagcctgaccaacatggtgaaaccccgtctccaataaaaatacaaaaattagccgggcgtggtggcgcccgcctgtaatcccagctactcaggaggctgaggcaggagaatcgcttgaatccgggaggcggagggtgcagtgagccgagatcgcgccactgcactccagcctgggtgacagagcgagactccgtccccaaagaaaaagaaaaaagggaactggagcggagggccctggagtgggaggagccagggctggtaaaggtggagacccctcaaggtaggagaaacaagagcggggttcctgagaggtgcttgagttgaatggaggacatgggaggaaaagagagtgcttgttccagaaatgtgtagctgggccttgttttcccaggtaatccacccaccgccacttcaagaagaaatgatatgaagaagtgccggttctccctcccctcttccgcactgtcccgtgatgatgacgcctccagagaggacgataatctgggttcctgggagagatggcttggtcactattcccacccttgcctcgaccacttgtctcaatgtcaccacctcacgccctgttccagataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcagccctgtgtctgtgcttgagtgggggcgagcacggggctgagactagaggtcggcctctgcctggaaagtcccgatctctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggtcggagagatcttctcggcggccggcgccgccttcacgaagctcggggagctgacgatgcagctgcatcccgtggccgactcttctcctgcgggcgcgaagtggacggagacggaaatagagatgctgagggctgctgtgaagcgatttggggacgatcttaatcacatcagctgtgtcatcaaggaacggacagtggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgatgtgacactcagtgctctgaacgactccgatgccaacagtgacgtggtggatattgaagggctaggagaaactcctccagctaagaaactcaacttcgaccaggcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcaaaaaaaaaaa

SEQ ID NO: 286253 - DNA, 1523 bp, Homo sapiens
agcgatctagaggatcccaagaggctgaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcagccctgtgtctgtgcttgagtgggggcgagcacggggctgagactagaggtcggcctctgcctggaaagtcccgatctctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggtcggagagatcttctcggcggccggcgccgccttcacgaagctcggggagctgacgatgcagctgcatcccgtggccgactcttctcctgcgggcgcgaagtggacggagacggaaatagagatgctgagggctgctgtgaagcgatttggggacgatcttaatcacatcagctgtgtcatcaaggaacggacagtggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgatgtgacactcagtgctctgaacgactccgatgccaacagtgacgtggtggatattgaagggctaggagaaactcctccagctaagaaactcaacttcgaccaggcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcaaaaaaaaaaa

SEQ ID NO: 286254 - DNA, 1807 bp, Homo sapiens
  misc_feature (1777)..(1777): n is a, c, g, or t
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcagccctgtgtctgtgcttgagtgggggcgagcacggggctgagactagaggtcggcctctgcctggaaagtcccgatctctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggtcggagagatcttctcggcggccggcgccgccttcacgaagctcggggagctgacgatgcagctgcatcccgtggccgactcttctcctgcgggcgcgaagtggacggagacggaaatagagatgctgagggctgctgtgaagcgatttggggacgatcttaatcacatcagctgtgtcatcaaggaacggacagtggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgatgtgacactcagtgctctgaacgactccgatgccaacagtgacgtggtggatattgaagggctaggagaaactcctccagctaagaaactcaacttcgaccaggcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcaaaaaaaaaaataaaaancgacaacaggaaaacaactcccacatatta

SEQ ID NO: 286255 - DNA, 1109 bp, Homo sapiens
cccacgcgtccgcggacgcgtgggcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaataggtcggagagatcttctcggcggccggcgccgccttcacgaagctcggggagctgacgatgcagctgcatcccgtggccgactcttctcctgcgggcgcgaagtggacggagacggaaatagagatgctgagggctgctgtgaagcgatttggggacgatcttaatcacatcagctgtgtcatcaaggaacggacagtggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgatgtgacactcagtgctctgaacgactccgatgccaacagtgacgtggtggatattgaagggctaggagaaactcctccagctaagaaactcaacttcgaccaggcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcaaaaaaaaaaa

SEQ ID NO: 286256 - DNA, 1609 bp, Homo sapiens
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcagccctgtgtctgtgcttgagtgggggcgagcacggggctgagactagaggtcggcctctgcctggaaagtcccgatctctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggtcggagagatcttctcggcggccggcgccgccttcacgaagctcggggagctgacgatgcagctgcatcccgtggccgactcttctcctgcgggcgcgaagtggacggagacggaaatagagatgctgagggctgctgtgaagcgatttggggacgatcttaatcacatcagctgtgtcatcaaggaacggacagtggcccagataaaggccactgtgaaacgcaagtgtgacactcagtgctctgaacgactccgatgccaacagtgacgtggtggatattgaagggctaggagaaactcctccagctaagaaactcaacttcgaccaggcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcaaaaaaaaaaa

SEQ ID NO: 286257 - DNA, 2018 bp, Homo sapiens
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcagccctgtgtctgtgcttgagtgggggcgagcacggggctgagactagaggtcggcctctgcctggaaagtcccgatctctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggtcggagagatcttctcggcggccggcgccgccttcacgaagctcggggagctgacgatgcagctgcatcccgtggccgactcttctcctgcgggcgcgaagtggacggagacggaaatagagatgctgagggctgctgtgaagcgatttggggacgatcttaatcacatcagctgtgtcatcaaggaacggacagtggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgatgtgacactcagtgctctgaacgactccgatgccaacagtgacgtggtggatattgaagggctaggagaaactcctccagctaagaaactcaacttcgaccagccagggtaggagtcctcctcctcccacacagctgacggggttggggagaaagggctcacctggatggcagggcacggtctccgcaggggcccctcccttgtataggggtttcagaagagaaggtgctctcatacacagcgcagggcattggatcagtacgtagcagggtgtttcagggaggtgggagtggccttggaagcacactgggggctcgctccatctcggcccattttacttcctgttccagagcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcaaaaaaaaaaa

SEQ ID NO: 286258 - DNA, 2721 bp, Homo sapiens
  misc_feature (2631)..(2631): n is a, c, g, or t
  misc_feature (2694)..(2694): n is a, c, g, or t
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcagccctgtgtctgtgcttgagtgggggcgagcacggggctgagactagaggtcggcctctgcctggaaagtcccgatctctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggtcggagagatcttctcggcggccggcgccgccttcacgaagctcggggagctgacgatgcagctgcatcccgtggccgactcttctcctgcgggcgcgaagtggacggagacggaaatagagatgctgagggctgctgtgaagcgatttggggacgatcttaatcacatcagctgtgtcatcaaggaacggacagtggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgagcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcaaaaaaaaaaaaaaaaaaaaaaaaaaaaaaaaaaaaaaaaaaaaaaaaaaaaaaaataaaaaaaataacaatgcgcccgcatttcgagttaattggcccaattccccctattgagagtcggtttacaatttatggccctttgtttaacaacgccttaacgggaaaacccctgacgtcccccacctaaagcgctttgagaaaatcccgcttttccctgttgccgcaccaccaaggagccccccccggatcccctttctaaacagttgggcaaccaaaaacgcctatccaattggtaggcctttaaaattgggtccaaacccggggttatatcttggaaaaatccgcccattcttttaccgataaagccgaaaggggacaaatccctttataaacacctggataacccctggttaggtctgcgggttgtctcccatctgggtccaagagtccccttattacatgacggggcgtctcaaattcaaaggggcgaaaaacccgcctctttatgccgaatgggccacctagagggacctcatctcctcaaaacacggttctcttgggacagggcgccactaaaggctcttaatgggcgacctacaagttggtccccctttaacgccttacatgttttatgccgccccaccggcgcgaaaccctatatttctctacaaggagccgcctcttattgactctcctctccaaacacgccgacccttgtcgtgatacaacacacacgtgccgcttctacagtcgccggtacaccggcgctctctaaacagacattttcccttctgtcttcgccacatactcctcctctcggcttttttcgtgcggtcactatcgaggtcttctctacaacagtaggctgctctctacacaatcgttcaggactcctctctactatctccgccatcgtcatactcgttgtggcccttcatacatcatctctttccgccactattatatagacgcgtntctcactaccgctctcgggctcacgtactctctcttgctcacttacgtctcgccacagcgtcntctctcgcctctttcttctcctgctct

SEQ ID NO: 286259 - DNA, 859 bp, Homo sapiens
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgtaatccacccaccgccacttcaagaagaaatgatatgaagaagtgccggttctccctcccctcttccgcactgtcccgtgatgatgacgcctccagagaggacgataatctgggttcctgggagagatggcttggtcactattcccacccttgcctcgaccacttgtctcaatgtcaccacctcacgccctgttccagataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttca

SEQ ID NO: 286260 - DNA, 1815 bp, Homo sapiens
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcagccctgtgtctgtgcttgagtgggggcgagcacggggctgagactagaggtcggcctctgcctggaaagtcccgatctctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggttcgacctccctcgcggacagcgctccctggcggccacgggagggcgggccccccacttggctcgcggctcttccgccccgggcggggggcgggcgggagccgagcctggggtggggctaggggctccgggcgggacggggagggcgggcgccggccccccgtgacgctgccccgcccccaggtcggagagatcttctcggcggccggcgccgccttcacgaagctcggggagctgacgatgcagctgcatcccgtggccgactcttctcctgcgggcgcgaagtggacggagacggaaatagagatgctgagggctgctgtgaagcgatttggggacgatcttaatcacatcagctgtgtcatcaaggaacggacagtggcccagataaaggccactgtgaaacgcaagtgtgacactcagtgctctgaacgactccgatgccaacagtgacgtggtggatattgaagggctaggagaaactcctccagctaagaaactcaacttcgaccaggcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcaaaaaaaaaaagcttcgtgctgtctgcttaacat

SEQ ID NO: 286261 - DNA, 1202 bp, Homo sapiens
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcattctcttaaacaaaaaaaaaaaaaaaaaaaaaacaacaaaagtttgtgggcgcgctatcgacccctaaaaaaaagtttttcagacaccccactcgtgcttggggggcgggggcccaagtggtttatgtgccaccctgggcccaagcggggtcccaaggaaaccgggccccagaacatggggtgctggttttctccacccaaaaaaaagcgcgcggcggcaccccgcgcggtctagacaaccccagggggcgctctggcgactcgtgccgaacctctacggcccagcaagccagatgcatccctgcacggccgggggagtgggggaaacagagctcagcacagacaagacgagcaaccacgaggcagatggcagacggacgacagcagacccgaataggatcaggatagcagcacaacgataacgagcaaaggaaacgagaatacaagacgagatcaggagcagacaatagctggagatacacacagccgagtacacgagacgcaagagacatcgaacgaaagaacatggaggacacacgtg

SEQ ID NO: 286262 - DNA, 1149 bp, Homo sapiens
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcaaaaaaaaatcttatcaaacacaacctacacagcaccctcacatcagtcatacacaacactatacttttctcactcgacagtaaaacacagaacaaaaaatatttactctgaccagtccctacaacgctggaatacttgtttctattcgtagtgtcgcacgcctatgacttgctactcggtctatgtgctaacacatgaggagcaggcacgcgcgggcaggactcatacacatcatcagtcgtggtcgtctcagcggggtataacagtcatcactagtttacaacaagcgcggctcgagtactcttaaaacttgttattccattctcactcccataatatttcttattttgttttctacttaaatcttatcttctcatgtagtgctacctaatcttatattgattcgatatcttacaatctaatatctacctcctcccgattacgtcctgttaatattttagatcaccgattagcttactccttcctcc

SEQ ID NO: 286263 - DNA, 829 bp, Homo sapiens
  misc_feature (665)..(665): n is a, c, g, or t
  misc_feature (668)..(668): n is a, c, g, or t
  misc_feature (670)..(670): n is a, c, g, or t
  misc_feature (675)..(676): n is a, c, g, or t
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcataanaananaaaannaaaaaaaaaacaaaatgttggggccgctcgggccagtcggatcttgactcagcaaacttattcatgcggccgcaatttaggtcacttggcccaattgcccatagggggcggtatacaatatataggccgcggttttcaaacacgggcatggga

SEQ ID NO: 286264 - DNA, 1007 bp, Homo sapiens
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgtgtgtcccgtatctaaataaagagaatcgctctcttaagagagaaagaaaaaagttcttttatatggggcgaagtgtatccctttggtggggtaatttagttggacggcggtgtttaaaaggcggacgggaaacttggggtaccaataagggttgagaaacccgttgcggtgggaaatagaaggccgccgtttcttcaagtgccctgaatggaagaccccttaggcaaaacggggttttgtagcgacgtaattgagcccgcgcttgttttttgttgaaggggccgaaaaaagggttggttttttccccccagagagtgtggcgcacagtttgggtatgatgacaaacattttgtttgagagagaaaaagagggggtgttggttgggtgtcgtgtgttatgatttga

SEQ ID NO: 286265 - DNA, 635 bp, Homo sapiens
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgtcccgtatctcaataaagagaatctgctctctta

SEQ ID NO: 286266 - DNA, 897 bp, Homo sapiens
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgtaatccacccaccgccacttcaagaagaaatgatatgaagaagtgccggttctccctcccctcttccgcactgtcccgtgatgatgacgcctccagagaggacgataatctgggttcctgggagagatggcttggtcactattcccacccttgcctcgaccacttgtctcaatgtcaccacctcacgccctgttccagataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcaaaaaaaaaaaacctttctctggaaaggggcccggtacc

SEQ ID NO: 286267 - DNA, 263 bp, Homo sapiens
cccacgcgtccgcggacgcgtgggcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatctcaataaagagaatctgctctcttca

SEQ ID NO: 286268 - DNA, 638 bp, Homo sapiens
cccacgcgtccgcggacgcgtgggcccgcttgcacctcggcgatccccgactcccttctttatggcgtcgctcctgtgctgtgggccgaagctggccgcctgcggcatcgtcctcagcgcctggggagtgatcatgttgtaatccacccaccgccacttcaagaagaaatgatatgaagaagtgccggttctccctcccctcttccgcactgtcccgtgatgatgacgcctccagagaggacgataatctgggttcctgggagagatggcttggtcactattcccacccttgcctcgaccacttgtctcaatgtcaccacctcacgccctgttccaggtggctgagtccgaatccagtaaccaccacctcgttttggttaatctcaggctcgggtgttgtagcaacattggaaatgggaggggtttacgaagtgaacatgaggtcaggtgcctgaattcaacagtctacccattccccttttccagataatgctcggaatatttttcaatgtccattccgctgtgttgattgaggacgttcccttcacggagaaagattttgagtaagtattcgggtgggggaggcgggctgggagcaggtgggaggtggcgaggcctagggtcagaattacgtctgg

SEQ ID NO: 286269 - DNA, 1968 bp, Homo sapiens
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgtaatccacccaccgccacttcaagaagaaatgatatgaagaagtgccggttctccctcccctcttccgcactgtcccgtgatgatgacgcctccagagaggacgataatctgggttcctgggagagatggcttggtcactattcccacccttgcctcgaccacttgtctcaatgtcaccacctcacgccctgttccagataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcagccctgtgtctgtgcttgagtgggggcgagcacggggctgagactagaggtcggcctctgcctggaaagtcccgatctctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggtcggagagatcttctcggcggccggcgccgccttcacgaagctcggggagctgacgatgcagctgcatcccgtggccgactcttctcctgcgggcgcgaagtggacggagacggaaatagagatgctgagggctgctgtgaagcgatttggggacgatcttaatcacatcagctgtgtcatcaaggaacggacagtggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgatgtgacactcagtgctctgaacgactccgatgccaacagtgacgtggtggatattgaagggctaggagaaactcctccagctaagaaactcaacttcgaccaggcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcaaaaaaaaaaa

SEQ ID NO: 286270 - DNA, 2418 bp, Homo sapiens
cccacgcgtccgcggacgcgtgggcccgcttgcacctcggcgatccccgactcccttctttatggcgtcgctcctgtgctgtgggccgaagctggccgcctgcggcatcgtcctcagcgcctggggagtgatcatgttggtgaggggactccccggcaaggatcggagagggcctgaggggctccgggctgggagggctgggaggcgaggaaactctgggccgcaggcaggccggaggggccggggatctacaggccccggagaaggagacagactgaaattgaaaaatgggaactgttcgagaccagcctgaccaacatggtgaaaccccgtctccaataaaaatacaaaaattagccgggcgtggtggcgcccgcctgtaatcccagctactcaggaggctgaggcaggagaatcgcttgaatccgggaggcggagggtgcagtgagccgagatcgcgccactgcactccagcctgggtgacagagcgagactccgtccccaaagaaaaagaaaaaagggaactggagcggagggccctggagtgggaggagccagggctggtaaaggtggagacccctcaaggtaggagaaacaagagcggggttcctgagaggtgcttgagttgaatggaggacatgggaggaaaagagagtgcttgttccagaaatgtgtagctgggccttgttttcccaggtaatccacccaccgccacttcaagaagaaatgatatgaagaagtgccggttctccctcccctcttccgcactgtcccgtgatgatgacgcctccagagaggacgataatctgggttcctgggagagatggcttggtcactattcccacccttgcctcgaccacttgtctcaatgtcaccacctcacgccctgttccaggtggctgagtccgaatccagtaaccaccacctcgttttggttaatctcaggctcgggtgttgtagcaacattggaaatgggaggggtttacgaagtgaacatgaggtcaggtgcctgaattcaacagtctacccattccccttttccagataatgctcggaatatttttcaatgtccattccgctgtgttgattgaggacgttcccttcacggagaaagattttgagtaagtattcgggtgggggaggcgggctgggagcaggtgggaggtggcgaggcccgggcgagagactgaatcccttctcccatctctggcatccggcccccgtggagagggctgaggctggggggctgttccgtctctccacccttcgctgtgtcccgtatctcaataaagagaatctgctctcttcagccctgtgtctgtgcttgagtgggggcgagcacggggctgagactagaggtcggcctctgcctggaaagtcccgatctctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggtcggagagatcttctcggcggccggcgccgccttcacgaagctcggggagctgacgatgcagctgcatcccgtggccgactcttctcctgcgggcgcgaagtggacggagacggaaatagagatgctgagggctgctgtgaagcgatttggggacgatcttaatcacatcagctgtgtcatcaaggaacggacagtggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgatgtgacactcagtgctctgaacgactccgatgccaacagtgacgtggtggatattgaagggctaggagaaactcctccagctaagaaactcaacttcgaccaggcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcaaaaaaaaaaa

SEQ ID NO: 286271 - DNA, 1793 bp, Homo sapiens
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcagccctgtgtctgtgcttgagtgggggcgagcacggggctgagactagaggtcggcctctgcctggaaagtcccgatctctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggtcggagagatcttctcggcggccggcgccgccttcacgaagctcggggagctgacgatgcagctgcatcccgtggccgactcttctcctgcgggcgcgaagtggacggagacggaaatagagatgctgagggctgctgtgaagcgatttggggacgatcttaatcacatcagctgtgtcatcaaggaacggacagtggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgatgtgacactcagtgctctgaacgactccgatgccaacagtgacgtggtggatattgaagggctaggagaaactcctccagctaagaaactcaacttcgaccaggcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcaaaaaaaaaaagcttcgtgctgtctgcttaacat

SEQ ID NO: 286272 - DNA, 1667 bp, Homo sapiens
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcagccctgtgtctgtgcttgagtgggggcgagcacggggctgagactagaggtcggcctctgcctggaaagtcccgatctctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggtcggagagatcttctcggcggccggcgccgccttcacgaagctcggggagctgacgatgcagctgcatcccgtggccgactcttctcctgcgggcgcgaagtggacggagacggaaatagagatgctgagggctgctgtgaagcgatttggggacgatcttaatcacatcagctgtgtcatcaaggaacggacagtggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgagcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcaaaaaaaaaaa

SEQ ID NO: 286273 - DNA, 824 bp, Homo sapiens
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcaaaaaaaaaaaaaaaaaaaaaaaaaaaaaaaaaaataaaatacacataaaaaaaaaaggggggggcgcgcccccaaagaagtttcccccggggggggccccagttttgggcctccccccctttttttgtgacacaggggggcccctttgggggcggcgttttta

SEQ ID NO: 286274 - DNA, 1360 bp, Homo sapiens
cccacgcgtccgcggacgcgtgggcccgcttgcacctcggcgatccccgactcccttctttatggcgtcgctcctgtgctgtgggccgaagctggccgcctgcggcatcgtcctcagcgcctggggagtgatcatgttggtgaggggactccccggcaaggatcggagagggcctgaggggctccgggctgggagggctgggaggcgaggaaactctgggccgcaggcaggccggaggggccggggatctacaggccccggagaaggagacagactgaaattgaaaaatgggaactgttcgagaccagcctgaccaacatggtgaaaccccgtctccaataaaaatacaaaaattagccgggcgtggtggcgcccgcctgtaatcccagctactcaggaggctgaggcaggagaatcgcttgaatccgggaggcggagggtgcagtgagccgagatcgcgccactgcactccagcctgggtgacagagcgagactccgtccccaaagaaaaagaaaaaagggaactggagcggagggccctggagtgggaggagccagggctggtaaaggtggagacccctcaaggtaggagaaacaagagcggggttcctgagaggtgcttgagttgaatggaggacatgggaggaaaagagagtgcttgttccagaaatgtgtagctgggccttgttttcccaggtaatccacccaccgccacttcaagaagaaatgatatgaagaagtgccggttctccctcccctcttccgcactgtcccgtgatgatgacgcctccagagaggacgataatctgggttcctgggagagatggcttggtcactattcccacccttgcctcgaccacttgtctcaatgtcaccacctcacgccctgttccagataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttca

SEQ ID NO: 286275 - DNA, 2005 bp, Homo sapiens
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcagccctgtgtctgtgcttgagtgggggcgagcacggggctgagactagaggtcggcctctgcctggaaagtcccgatctctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggttcgacctccctcgcggacagcgctccctggcggccacgggagggcgggccccccacttggctcgcggctcttccgccccgggcggggggcgggcgggagccgagcctggggtggggctaggggctccgggcgggacggggagggcgggcgccggccccccgtgacgctgccccgcccccaggtcggagagatcttctcggcggccggcgccgccttcacgaagctcggggagctgacgatgcagctgcatcccgtggccgactcttctcctgcgggcgcgaagtggacggagacggaaatagagatgctgagggctgctgtgaagcgatttggggacgatcttaatcacatcagctgtgtcatcaaggaacggacagtggcccagataaaggccactgtgaaacgcaaggtgacgtggtggatattgaagggctaggagaaactcctccagctaagaaactcaacttcgaccaggcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcaaaaaaaaaaaaaaaaacaaaacaaaaacacaacttttgggggccggcctcgggaccacgaaaaaaggtgttctctaacacccatttccgtgtgggccgcgggcccagtaaggaaagtgagctggccatacggggtcgaaggagaacccggggcatggcatagggcgggttccccaaaaaaaccgcggcggccagcggtttgacacccagagggtccgggcctcgggcccacagggccacgcgaccgccccacgccaggagt

SEQ ID NO: 286276 - DNA, 865 bp, Homo sapiens
  misc_feature (665)..(665): n is a, c, g, or t
  misc_feature (670)..(670): n is a, c, g, or t
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcaaaanacaancaaaacacccacacaaaaaacacaactttctggcccccacaagcctctgtataaccttttacagaacacaatacagtgatcgcccgctggccccattaggtcacagtgctacacgtgtgttacgagtgtttctccggacaccataccgcggtcacaacacatgcgatgtacatttctcacacattacaaaaacgg

SEQ ID NO: 286277 - DNA, 699 bp, Homo sapiens
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgttccgtctctccacccttcgctgtgtcccgtatctcaataaagagaatctgctctcttcaaaaaaaaaaaacctttctctggaaaggggcccggtacc

SEQ ID NO: 286278 - DNA, 755 bp, Homo sapiens
aattcgcggccgcgtcgacacggctggagaagacgacagaagggggagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatcccttctcccatctctggcatccggcccccgtggagagggctgaggctggggggctgtcccgtatctcaataaagagaatctgctctcttaaaaaaaacaaaacaaaaaaacatttttgcggggctcgggacccagaaaaacttttaaaaacctcggttgggcgggggccccatattggatgtgaactgggcaaagggttccaagaaaacc

SEQ ID NO: 286279 - DNA, 394 bp, Homo sapiens
cgagcctggggtggggctaggggctccgggcgggacggggagggcgggcgccggccccccgtgacgctgccccgcccccaggtcggagagatcttctcggcggccggcgccgccttcacgaagctcggggagctgacgatgcagctgcatcccgtggccgactcttctcctgcggggtacgtgagcccggactgggacgtggacgctgagagcgggcgcttggactcggtcacagacacggaccctctctagcacagggacagacattagtttccctttgtgcgtggcacagcacagagtcggtgttaataaatgatcgttgggtgagggaatgaatgacagataaaaatacagacaggcccatagcccagactcctgtttcacagttctccct

SEQ ID NO: 286280 - DNA, 555 bp, Homo sapiens
gttcaagcgattcttctgcctcagcctcccgagtagctgggattacaggcacctgtcaccacgcctggctaatttttgtagttttttagtagttacgggatttcaccatcttggccaggctggtcttgaactcctgacctcgtgatccacccacctcggcctcccaaagtgctgggattacaggcatgagccaccgcgcccatcctgtactcactttttcatactcctttgcaggttggctgtgataggtgtccctggccacgtcagtggagcacccaggcctcaagcagcatgctggggaagggaaaaccccccattctggtgatggaggtggccatgaccatgtctggttttcaaaggcagctttgtaagaacagaaaccagcagctccccaacatctggccctatctgctgtgcaaaccacagggaccaggacctttccggggtgccagtggcatcctctggaaccagcttctcagtggaatttcagatgctattcctggtcaattgcctttgctatgtgctatcctttaataaattctgtttctcctcata

SEQ ID NO: 286281 - DNA, 396 bp, Homo sapiens
cagtcacagcaagctcacttcacaggaaccaagctgtgggctgatcctacagacttgaaaagacaactcaaaaaggttggctgtgataggtgtccctggccacgtcagtggagcacccaggcctcaagcagcatgctggggaagggaaaaccccccattctggtgatggaggtggccatgaccatgtctggttttcaaaggcagctttgtaagaacagaaaccagcagctccccaacatctggccctatctgctgtgcaaaccacagggaccaggacctttccggggtgccagtggcatcctctggaaccagcttctcagtggaatttcagatgctattcctggtcaattgcctttgctatgtgctatcctttaataaattctgtttctcctcata

SEQ ID NO: 286282 - DNA, 771 bp, Homo sapiens
gtgggaggatagcttgagcctgggaggtcgaggctgcagtgagctgattgcaccattgcactctaggatgacagagtgagaccctgtctcaaaaaaacaaaacaaaaattgccctgatccacacaaattcttggttttgtttttataaatgtgcttctataaaatgaaagccaaagtgttctgttatttcagtttttttttttaatctccttttaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtga

SEQ ID NO: 286283 - DNA, 909 bp, Homo sapiens
agcacgcacggcgtcggtgcgtgcgcgcccagacgttctgccgggtggcagtcccagcggagtttgcgggtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtga

SEQ ID NO: 286284 - DNA, 1446 bp, Homo sapiens
agcacgcacggcgtcggtgcgtgcgcgcccagacgttctgccgggtggcagtcccagcggagtttgcgggtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtgagcctgtgcgttttgcatactgggttggtttgctggggctgcggtgacagcatatgccgcgagctgggctttaacagagatgtgtgctctcacagctttgcaggcgggggtctgagatcagggtgtcgcgggtggggggtcactgctgaggccgtgaggggaatctgctcaggcctgtccctggcttctgggggctgctggtggtattttcagttccttggtgtgtggatacttcgccccatctctgccttcacctgtgtcctccctgtgtgggtgctggtgtccaaaatttccccttttcgtagtgacaccagctgtgttggattggggcccaccctgctccagcatggcctaatcttaactaattacatttgcaaggatcttatgtccacaaaagtcacagtctgaggtgctgggggttaggacttcaatatataaattttgcggttacacaattcaatccatgacagaatccaaaggtttactctggttataaaaacagtacaataaaatattgtttatagccttccctgtaagg

SEQ ID NO: 286285 - DNA, 797 bp, Homo sapiens
agcacgcacggcgtcggtgcgtgcgcgcccagacgttctgccgggtggcagtcccagcggagtttgcgggtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtga

SEQ ID NO: 286286 - DNA, 904 bp, Homo sapiens
agcacgcacggcgtcggtgcgtgcgcgcccagacgttctgccgggtggcagtcccagcggagtttgcgggtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgaaaaaaccaaaaaaaaaccggggtttttgggggggggaaaaaggggtgagggcggttgttcggccgcttttggaaagggggagcggggccaaagggggaagaaccgac

SEQ ID NO: 286287 - DNA, 597 bp, Homo sapiens
ggttagaatggctgaaaatgtaagggctttgtatgtgttaatgttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtga

SEQ ID NO: 286288 - DNA, 1002 bp, Homo sapiens
agcacgcacggcgtcggtgcgtgcgcgcccagacgttctgccgggtggcagtcccagcggagtttgcgggtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggtggtggcataaacatcgggtggtgttcagatcctgctgccggcagctcgaggctaggatggctggagatgtgagggcctttgtctcatcacatccgagcacagctcagcaagatgctcttagctaggaaacagattttatgtgttaatgttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagcgatgcggccgaagtcttgtcttacaataaagatcttacgtaacatatagtctct

SEQ ID NO: 286289 - DNA, 563 bp, Homo sapiens
cggacgcgtgggtcgacccacgcgtccggatggctggagatgtgagggcctttgtctcatcacatccgagcacagctcagcaagatgctcttagctaggaaacagattttatgtgttaatgttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtga

SEQ ID NO: 286290 - DNA, 522 bp, Homo sapiens
  misc_feature (28)..(28): n is a, c, g, or t
  misc_feature (30)..(30): n is a, c, g, or t
  misc_feature (36)..(36): n is a, c, g, or t
aagactgaagcgagaagggcagcgcgantnggcacnacggcgagcgagcggcgtgtaggcggggtgaagacaacgccaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtga

SEQ ID NO: 286291 - DNA, 483 bp, Homo sapiens
gttatggcgtgactgactctcttactaaccagcgctacaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtga

SEQ ID NO: 286292 - DNA, 552 bp, Homo sapiens
  misc_feature (28)..(28): n is a, c, g, or t
  misc_feature (30)..(30): n is a, c, g, or t
  misc_feature (36)..(36): n is a, c, g, or t
aagactgaagcgagaagggcagcgcgantnggcacnacggcgagcgagcggcgtgtaggcggggtgaagacaacgccaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgaaaaaaaaaaaatcggtctcgttggcactca

SEQ ID NO: 286293 - DNA, 693 bp, Homo sapiens
agcacgcacggcgtcggtgcgtgcgcgcccagacgttctgccgggtggcagtcccagcggagtttgcgggtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtga

SEQ ID NO: 286294 - DNA, 3171 bp, Homo sapiens
agcacgcacggcgtcggtgcgtgcgcgcccagacgttctgccgggtggcagtcccagcggagtttgcgggtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtgagcctgtgcgttttgcatactgggttggtttgctggggctgcggtgacagcatatgccgcgagctgggctttaacagagatgtgtgctctcacagctttgcaggcgggggtctgagatcagggtgtcgcgggtggggggtcactgctgaggccgtgaggggaatctgctcaggcctgtccctggcttctgggggctgctggtggtattttcagttccttggtgtgtggatacttcgccccatctctgccttcacctgtgtcctccctgtgtgggtgctggtgtccaaaatttccccttttcgtagtgacaccagctgtgttggattggggcccaccctgctccagcatggcctaatcttaactaattacatttgcaaggatcttatgtccacaaaagtcacagtctgaggtgctgggggttaggacttcaatatataaattttgcggttacacaattcaatccatgacagaatccaaaggtttactctggttataaaaacagtacaataaaatattgtttatagccttccctgtaaggaataggagagctattttttattcttcccaagattgtatttgatgtaaacatattttctgtagaagccatggcccttcagttcatatagttagaaaatttccttattggccaggcacggtggctcacacctgtaatcccagcactttgggaggccgaggtgggcagatcacgaagtcaggtgttcgagaccagcctggccaacatggtgaaatcccgtctctactaaaaatacaaaaattagctgggcatggtggcgcgtgcctgtaatcccagctacttggaaggctgaggcaggagaattgcttgaacccgggaggtggaggtttcagtgagccgagatcacaccactgcactccagcctgggcaacagagcaagactccgtctcaaaaaaagaaaagaaaatgtccttattacagtctcaggtttctcttgccctctgtcatcctagcagtgtggatggttggttgggatcttcgtgtcccgtctcagcacactcgagctctgaagtgaaagtgaggaagggcagggatgggggcacttgagcacaccgtgggccctctgacctcagacccaggctctgccccaccaagtgaccttgggcagggtaccttctctgagctttgtttcctccttggtaaaggcggataatagtgtctgccctgcacacagatgtggacgcagaagcacgtggtgcctgccgggcacaggagtggtgcacagggctcgctgctgtcgggagattgattgctgttgtggaaacgggagggtacttacagaatgaagcacattttttacatacagtacaaatgagtgtgtgctttttaaatggatttaaaattcaaatgcaaatctgcagtttaatctcccaagtgctgatttttctatgtataaagtaggagagtgcaacagcgtatcagaatgaggggctagggagaacgtgtatgtgacctcgagtacctggcatgtaacagacactcagtattacactcctgctatttctccagagcaggtgaaacagacggccaggaagcacacgaagagacactcagcatcactgcttgttaaggaaggtgcaaatcaaaaccacagtgagacgccacttcacacctacaagttcggctagatacaaaaagatcgcaacaagcgtttgcaaggatgtggagaaattggagccctcacacactgctggtggcaaagtggtaacacaggcaggcaggtcgtcaaaaagttaaacatgggccgggtgcaggtgtctcaagcctgtaatcccagcactttggaaggctgagacaggcagattgcttgagcccaggagttcacgaccagcctgggcaacctggtgagaccctgtctctacaaaaaatacagaacaattagctgggcatggtggtgcgtgcctgtgggcccagctactcggcgggctgaggcaggaggatcacttaagccccagaggtcaaggctgcagtaagccatggttgtgccactgcactccagcctgggcaactgagcaagaccctgtctcaaaaaaataaaaaaagataaacatggtgttaccatttgacccagcagtttcatacccaggagaattgaacgcatatgtccacatagaaactcgtacacagaagccaaaatgtggaaacccacgtgtccatcaacagatgaacggttaaacaaaatgtccatccatagaacggaatattattcagtcataaacagaatgaagt

SEQ ID NO: 286295 - DNA, 1853 bp, Homo sapiens
agcacgcacggcgtcggtgcgtgcgcgcccagacgttctgccgggtggcagtcccagcggagtttgcgggtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtgagcctgtgcgttttgcatactgggttggtttgctggggctgcggtgacagcatatgccgcgagctgggctttaacagagatgtgtgctctcacagctttgcaggcgggggtctgagatcagggtgtcgcgggtggggggtcactgctgaggccgtgaggggaatctgctcaggcctgtccctggcttctgggggctgctggtggtattttcagttccttggtgtgtggatacttcgccccatctctgccttcacctgtgtcctccctgtgtgggtgctggtgtccaaaatttccccttttcgtagtgacaccagctgtgttggattggggcccaccctgctccagcatggcctaatcttaactaattacatttgcaaggatcttatgtccacaaaagtcacagtctgaggtgctgggggttaggacttcaatatataaattttgcggttacacaattcaatccatgacagaatccaaaggtttactctggttataaaaacagtacaataaaatattgtttatagccttccctgtaaggaataggagagctattttttattcttcccaagattgtatttgatgtaaacatattttctgtagaagccatggcccttcagttcatatagttagaaaatttccttattgccactgcacccggccggaggtacagcttttgctataggtgaggggtaattaacacatcaggaagccacataaaagcacagaagtaaatactgggaaatcctaagtaaactattacctactactaccagacaacaaaaagatactccatgataatctaccagtccgaaagaatcacagcatttgttaaaggtagaaaaggatatttctgaggtttaatgttgccgtcagagcttgaaaatgttcctgaagttcctgaaatagattttctgcctgaaaaaataaaccgtaagacaattgaat

SEQ ID NO: 286296 - DNA, 713 bp, Homo sapiens
atctagaggatcccgtacaagccgcactgcacaacggctggcaggtggaccaggccatcctctcggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtga

SEQ ID NO: 286297 - DNA, 684 bp, Homo sapiens
gcctactactactactaaattcgcggccgcgtcgaggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtga

SEQ ID NO: 286298 - DNA, 1058 bp, Homo sapiens
agcacgcacggcgtcggtgcgtgcgcgcccagacgttctgccgggtggcagtcccagcggagtttgcgggtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggtggtggcataaacatcgggtggtgttcagatcctgctgccggcagctcgaggctaggatggctggagatgtgagggcctttgtctcatcacatccgagcacagctcagcaagatgctcttagctaggaaacagattttatgtgttaatgttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtga

SEQ ID NO: 286299 - DNA, 604 bp, Homo sapiens
tcgatctcggtacctgaacattcgtgtcctgtacagcatcgccgagaaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtga

SEQ ID NO: 286300 - DNA, 759 bp, Homo sapiens
agcacgcacggcgtcggtgcgtgcgcgcccagacgttctgccgggtggcagtcccagcggagtttgcgggtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcttaataacacggtaccgagctga

SEQ ID NO: 286301 - DNA, 3390 bp, Homo sapiens
agcacgcacggcgtcggtgcgtgcgcgcccagacgttctgccgggtggcagtcccagcggagtttgcgggtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggtggtggcataaacatcgggtggtgttcagatcctgctgccggcagctcgaggctaggatggctggagatgtgagggcctttgtctcatcacatccgagcacagctcagcaagatgctcttagctaggaaacagattttatgtgttaatgttaaaaattttgcagttatttatcttgtggatattacagaagtgcctgacttcaacaaaatgtatgagttatacgatccatgtactgtcatgtttttcttcagttaccatagaggttggtgaattagctacatgagcattagaccattctccaaaggtggagcctcctactcggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtgagcctgtgcgttttgcatactgggttggtttgctggggctgcggtgacagcatatgccgcgagctgggctttaacagagatgtgtgctctcacagctttgcaggcgggggtctgagatcagggtgtcgcgggtggggggtcactgctgaggccgtgaggggaatctgctcaggcctgtccctggcttctgggggctgctggtggtattttcagttccttggtgtgtggatacttcgccccatctctgccttcacctgtgtcctccctgtgtgggtgctggtgtccaaaatttccccttttcgtagtgacaccagctgtgttggattggggcccaccctgctccagcatggcctaatcttaactaattacatttgcaaggatcttatgtccacaaaagtcacagtctgaggtgctgggggttaggacttcaatatataaattttgcggttacacaattcaatccatgacagaatccaaaggtttactctggttataaaaacagtacaataaaatattgtttatagccttccctgtaaggaataggagagctattttttattcttcccaagattgtatttgatgtaaacatattttctgtagaagccatggcccttcagttcatatagttagaaaatttccttattggccaggcacggtggctcacacctgtaatcccagcactttgggaggccgaggtgggcagatcacgaagtcaggtgttcgagaccagcctggccaacatggtgaaatcccgtctctactaaaaatacaaaaattagctgggcatggtggcgcgtgcctgtaatcccagctacttggaaggctgaggcaggagaattgcttgaacccgggaggtggaggtttcagtgagccgagatcacaccactgcactccagcctgggcaacagagcaagactccgtctcaaaaaaagaaaagaaaatgtccttattacagtctcaggtttctcttgccctctgtcatcctagcagtgtggatggttggttgggatcttcgtgtcccgtctcagcacactcgagctctgaagtgaaagtgaggaagggcagggatgggggcacttgagcacaccgtgggccctctgacctcagacccaggctctgccccaccaagtgaccttgggcagggtaccttctctgagctttgtttcctccttggtaaaggcggataatagtgtctgccctgcacacagatgtggacgcagaagcacgtggtgcctgccgggcacaggagtggtgcacagggctcgctgctgtcgggagattgattgctgttgtggaaacgggagggtacttacagaatgaagcacattttttacatacagtacaaatgagtgtgtgctttttaaatggatttaaaattcaaatgcaaatctgcagtttaatctcccaagtgctgatttttctatgtataaagtaggagagtgcaacagcgtatcagaatgaggggctagggagaacgtgtatgtgacctcgagtacctggcatgtaacagacactcagtattacactcctgctatttctccagagcaggtgaaacagacggccaggaagcacacgaagagacactcagcatcactgcttgttaaggaaggtgcaaatcaaaaccacagtgagacgccacttcacacctacaagttcggctagatacaaaaagatcgcaacaagcgtttgcaaggatgtggagaaattggagccctcacacactgctggtggcaaagtggtaacacaggcaggcaggtcgtcaaaaagttaaacatgggccgggtgcaggtgtctcaagcctgtaatcccagcactttggaaggctgagacaggcagattgcttgagcccaggagttcacgaccagcctgggcaacctggtgagaccctgtctctacaaaaaatacagaacaattagctgggcatggtggtgcgtgcctgtgggcccagctactcggcgggctgaggcaggaggatcacttaagccccagaggtcaaggctgcagtaagccatggttgtgccactgcactccagcctgggcaactgagcaagaccctgtctcaaaaaaataaaaaaagataaacatggtgttaccatttgacccagcagtttcatacccaggagaattgaacgcatatgtccacatagaaactcgtacacagaagccaaaatgtggaaacccacgtgtccatcaacagatgaacggttaaacaaaatgtccatccatagaacggaatattattcagtcataaacagaatgaagt

SEQ ID NO: 286302 - DNA, 2833 bp, Homo sapiens
tgcgttcttcagtgatgttaacaagagcttgtcacagtgggaaaaatacggcattgttttcaaggaattcttttttaaagagacttctatgagaatggatgcccttgtttctcgttgcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtgagcctgtgcgttttgcatactgggttggtttgctggggctgcggtgacagcatatgccgcgagctgggctttaacagagatgtgtgctctcacagctttgcaggcgggggtctgagatcagggtgtcgcgggtggggggtcactgctgaggccgtgaggggaatctgctcaggcctgtccctggcttctgggggctgctggtggtattttcagttccttggtgtgtggatacttcgccccatctctgccttcacctgtgtcctccctgtgtgggtgctggtgtccaaaatttccccttttcgtagtgacaccagctgtgttggattggggcccaccctgctccagcatggcctaatcttaactaattacatttgcaaggatcttatgtccacaaaagtcacagtctgaggtgctgggggttaggacttcaatatataaattttgcggttacacaattcaatccatgacagaatccaaaggtttactctggttataaaaacagtacaataaaatattgtttatagccttccctgtaaggaataggagagctattttttattcttcccaagattgtatttgatgtaaacatattttctgtagaagccatggcccttcagttcatatagttagaaaatttccttattggccaggcacggtggctcacacctgtaatcccagcactttgggaggccgaggtgggcagatcacgaagtcaggtgttcgagaccagcctggccaacatggtgaaatcccgtctctactaaaaatacaaaaattagctgggcatggtggcgcgtgcctgtaatcccagctacttggaaggctgaggcaggagaattgcttgaacccgggaggtggaggtttcagtgagccgagatcacaccactgcactccagcctgggcaacagagcaagactccgtctcaaaaaaagaaaagaaaatgtccttattacagtctcaggtttctcttgccctctgtcatcctagcagtgtggatggttggttgggatcttcgtgtcccgtctcagcacactcgagctctgaagtgaaagtgaggaagggcagggatgggggcacttgagcacaccgtgggccctctgacctcagacccaggctctgccccaccaagtgaccttgggcagggtaccttctctgagctttgtttcctccttggtaaaggcggataatagtgtctgccctgcacacagatgtggacgcagaagcacgtggtgcctgccgggcacaggagtggtgcacagggctcgctgctgtcgggagattgattgctgttgtggaaacgggagggtacttacagaatgaagcacattttttacatacagtacaaatgagtgtgtgctttttaaatggatttaaaattcaaatgcaaatctgcagtttaatctcccaagtgctgatttttctatgtataaagtaggagagtgcaacagcgtatcagaatgaggggctagggagaacgtgtatgtgacctcgagtacctggcatgtaacagacactcagtattacactcctgctatttctccagagcaggtgaaacagacggccaggaagcacacgaagagacactcagcatcactgcttgttaaggaaggtgcaaatcaaaaccacagtgagacgccacttcacacctacaagttcggctagatacaaaaagatcgcaacaagcgtttgcaaggatgtggagaaattggagccctcacacactgctggtggcaaagtggtaacacaggcaggcaggtcgtcaaaaagttaaacatgggccgggtgcaggtgtctcaagcctgtaatcccagcactttggaaggctgagacaggcagattgcttgagcccaggagttcacgaccagcctgggcaacctggtgagaccctgtctctacaaaaaatacagaacaattagctgggcatggtggtgcgtgcctgtgggcccagctactcggcgggctgaggcaggaggatcacttaagccccagaggtcaaggctgcagtaagccatggttgtgccactgcactccagcctgggcaactgagcaagaccctgtctcaaaaaaataaaaaaagataaacatggtgttaccatttgacccagcagtttcatacccaggagaattgaacgcatatgtccacatagaaactcgtacacagaagccaaaatgtggaaacccacgtgtccatcaacagatgaacggttaaacaaaatgtccatccatagaacggaatattattcagtcataaacagaatgaagt

SEQ ID NO: 286303 - DNA, 1016 bp, Homo sapiens
agcacgcacggcgtcggtgcgtgcgcgcccagacgttctgccgggtggcagtcccagcggagtttgcgggtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggtggtggcataaacatcgggtggtgttcagatcctgctgccggcagctcgaggctaggatggctggagatgtgagggcctttgtctcatcacatccgagcacagctcagcaagatgctcttagctaggaaacagattttatgtgttaatgttaaaaattttgcagttatttatcttgtggatattacagaagtgcctgacttcaacaaaatgtatgagttatacgatccatgtactgtcatgtttttcttcagttaccatagaggttggtgaattagctacatgagcattagaccattctccaaaggtggagcctcctactcggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtga

SEQ ID NO: 286304 - DNA, 853 bp, Homo sapiens
agcacgcacggcgtcggtgcgtgcgcgcccagacgttctgccgggtggcagtcccagcggagtttgcgggtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagcgatgcggccgaagtcttgtcttacaataaagatcttacgtaacatatagtctct

SEQ ID NO: 286305 - DNA, 953 bp, Homo sapiens
agacgtatctaccgagtaacagtcccaacaaagatattagtaggggcgagcagagcagagcacagcgaaagccagccatatacgtaacataactacccagcacctaagcacagacgagctaagacagagtagagaccaagaccatacctacacaggagagaggaccgcgtggtcgtcatccgcttcggccacgactgggatcctacgtgcatgaagatggacgaggtcctgtacagcatcgccgagaaggtggtggcataaacatcgggtggtgttcagatcctgctgccggcagctcgaggctaggatggctggagatgtgagggcctttgtctcatcacatccgagcacagctcagcaagatgctcttagctaggaaacagattttatgtgttaatgttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtga

SEQ ID NO: 286306 - DNA, 634 bp, Homo sapiens
  misc_feature (28)..(28): n is a, c, g, or t
  misc_feature (30)..(30): n is a, c, g, or t
  misc_feature (36)..(36): n is a, c, g, or t
aagactgaagcgagaagggcagcgcgantnggcacnacggcgagcgagcggcgtgtaggcggggtgaagacaacgccaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtga

SEQ ID NO: 286307 - DNA, 3241 bp, Homo sapiens
agcacgcacggcgtcggtgcgtgcgcgcccagacgttctgccgggtggcagtcccagcggagtttgcgggtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcagttaccatagaggttggtgaattagctacatgagcattagaccattctccaaaggtggagcctcctactcggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtgagcctgtgcgttttgcatactgggttggtttgctggggctgcggtgacagcatatgccgcgagctgggctttaacagagatgtgtgctctcacagctttgcaggcgggggtctgagatcagggtgtcgcgggtggggggtcactgctgaggccgtgaggggaatctgctcaggcctgtccctggcttctgggggctgctggtggtattttcagttccttggtgtgtggatacttcgccccatctctgccttcacctgtgtcctccctgtgtgggtgctggtgtccaaaatttccccttttcgtagtgacaccagctgtgttggattggggcccaccctgctccagcatggcctaatcttaactaattacatttgcaaggatcttatgtccacaaaagtcacagtctgaggtgctgggggttaggacttcaatatataaattttgcggttacacaattcaatccatgacagaatccaaaggtttactctggttataaaaacagtacaataaaatattgtttatagccttccctgtaaggaataggagagctattttttattcttcccaagattgtatttgatgtaaacatattttctgtagaagccatggcccttcagttcatatagttagaaaatttccttattggccaggcacggtggctcacacctgtaatcccagcactttgggaggccgaggtgggcagatcacgaagtcaggtgttcgagaccagcctggccaacatggtgaaatcccgtctctactaaaaatacaaaaattagctgggcatggtggcgcgtgcctgtaatcccagctacttggaaggctgaggcaggagaattgcttgaacccgggaggtggaggtttcagtgagccgagatcacaccactgcactccagcctgggcaacagagcaagactccgtctcaaaaaaagaaaagaaaatgtccttattacagtctcaggtttctcttgccctctgtcatcctagcagtgtggatggttggttgggatcttcgtgtcccgtctcagcacactcgagctctgaagtgaaagtgaggaagggcagggatgggggcacttgagcacaccgtgggccctctgacctcagacccaggctctgccccaccaagtgaccttgggcagggtaccttctctgagctttgtttcctccttggtaaaggcggataatagtgtctgccctgcacacagatgtggacgcagaagcacgtggtgcctgccgggcacaggagtggtgcacagggctcgctgctgtcgggagattgattgctgttgtggaaacgggagggtacttacagaatgaagcacattttttacatacagtacaaatgagtgtgtgctttttaaatggatttaaaattcaaatgcaaatctgcagtttaatctcccaagtgctgatttttctatgtataaagtaggagagtgcaacagcgtatcagaatgaggggctagggagaacgtgtatgtgacctcgagtacctggcatgtaacagacactcagtattacactcctgctatttctccagagcaggtgaaacagacggccaggaagcacacgaagagacactcagcatcactgcttgttaaggaaggtgcaaatcaaaaccacagtgagacgccacttcacacctacaagttcggctagatacaaaaagatcgcaacaagcgtttgcaaggatgtggagaaattggagccctcacacactgctggtggcaaagtggtaacacaggcaggcaggtcgtcaaaaagttaaacatgggccgggtgcaggtgtctcaagcctgtaatcccagcactttggaaggctgagacaggcagattgcttgagcccaggagttcacgaccagcctgggcaacctggtgagaccctgtctctacaaaaaatacagaacaattagctgggcatggtggtgcgtgcctgtgggcccagctactcggcgggctgaggcaggaggatcacttaagccccagaggtcaaggctgcagtaagccatggttgtgccactgcactccagcctgggcaactgagcaagaccctgtctcaaaaaaataaaaaaagataaacatggtgttaccatttgacccagcagtttcatacccaggagaattgaacgcatatgtccacatagaaactcgtacacagaagccaaaatgtggaaacccacgtgtccatcaacagatgaacggttaaacaaaatgtccatccatagaacggaatattattcagtcataaacagaatgaagt

SEQ ID NO: 286308 - DNA, 3067 bp, Homo sapiens
agcacgcacggcgtcggtgcgtgcgcgcccagacgttctgccgggtggcagtcccagcggagtttgcgggtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtgagcctgtgcgttttgcatactgggttggtttgctggggctgcggtgacagcatatgccgcgagctgggctttaacagagatgtgtgctctcacagctttgcaggcgggggtctgagatcagggtgtcgcgggtggggggtcactgctgaggccgtgaggggaatctgctcaggcctgtccctggcttctgggggctgctggtggtattttcagttccttggtgtgtggatacttcgccccatctctgccttcacctgtgtcctccctgtgtgggtgctggtgtccaaaatttccccttttcgtagtgacaccagctgtgttggattggggcccaccctgctccagcatggcctaatcttaactaattacatttgcaaggatcttatgtccacaaaagtcacagtctgaggtgctgggggttaggacttcaatatataaattttgcggttacacaattcaatccatgacagaatccaaaggtttactctggttataaaaacagtacaataaaatattgtttatagccttccctgtaaggaataggagagctattttttattcttcccaagattgtatttgatgtaaacatattttctgtagaagccatggcccttcagttcatatagttagaaaatttccttattggccaggcacggtggctcacacctgtaatcccagcactttgggaggccgaggtgggcagatcacgaagtcaggtgttcgagaccagcctggccaacatggtgaaatcccgtctctactaaaaatacaaaaattagctgggcatggtggcgcgtgcctgtaatcccagctacttggaaggctgaggcaggagaattgcttgaacccgggaggtggaggtttcagtgagccgagatcacaccactgcactccagcctgggcaacagagcaagactccgtctcaaaaaaagaaaagaaaatgtccttattacagtctcaggtttctcttgccctctgtcatcctagcagtgtggatggttggttgggatcttcgtgtcccgtctcagcacactcgagctctgaagtgaaagtgaggaagggcagggatgggggcacttgagcacaccgtgggccctctgacctcagacccaggctctgccccaccaagtgaccttgggcagggtaccttctctgagctttgtttcctccttggtaaaggcggataatagtgtctgccctgcacacagatgtggacgcagaagcacgtggtgcctgccgggcacaggagtggtgcacagggctcgctgctgtcgggagattgattgctgttgtggaaacgggagggtacttacagaatgaagcacattttttacatacagtacaaatgagtgtgtgctttttaaatggatttaaaattcaaatgcaaatctgcagtttaatctcccaagtgctgatttttctatgtataaagtaggagagtgcaacagcgtatcagaatgaggggctagggagaacgtgtatgtgacctcgagtacctggcatgtaacagacactcagtattacactcctgctatttctccagagcaggtgaaacagacggccaggaagcacacgaagagacactcagcatcactgcttgttaaggaaggtgcaaatcaaaaccacagtgagacgccacttcacacctacaagttcggctagatacaaaaagatcgcaacaagcgtttgcaaggatgtggagaaattggagccctcacacactgctggtggcaaagtggtaacacaggcaggcaggtcgtcaaaaagttaaacatgggccgggtgcaggtgtctcaagcctgtaatcccagcactttggaaggctgagacaggcagattgcttgagcccaggagttcacgaccagcctgggcaacctggtgagaccctgtctctacaaaaaatacagaacaattagctgggcatggtggtgcgtgcctgtgggcccagctactcggcgggctgaggcaggaggatcacttaagccccagaggtcaaggctgcagtaagccatggttgtgccactgcactccagcctgggcaactgagcaagaccctgtctcaaaaaaataaaaaaagataaacatggtgttaccatttgacccagcagtttcatacccaggagaattgaacgcatatgtccacatagaaactcgtacacagaagccaaaatgtggaaacccacgtgtccatcaacagatgaacggttaaacaaaatgtccatccatagaacggaatattattcagtcataaacagaatgaagt

SEQ ID NO: 286309 - DNA, 946 bp, Homo sapiens
agcacgcacggcgtcggtgcgtgcgcgcccagacgttctgccgggtggcagtcccagcggagtttgcgggtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggtggtggcataaacatcgggtggtgttcagatcctgctgccggcagctcgaggctaggatggctggagatgtgagggcctttgtctcatcacatccgagcacagctcagcaagatgctcttagctaggaaacagattttatgtgttaatgttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtga

SEQ ID NO: 286310 - DNA, 1361 bp, Homo sapiens
agcggccgcagctgaagttgggccgagagccggcgacggccccgcgccggggtcgcagggtaccagtgtgcggagttcctgttgccaagctgaaggtggccctgggcaggcacaggtgtggtcatatcttcagccaacaggaccatcctccggagggccacctctggggacttcctacgggaagagagtgacagatttggtgcttctgtgtgtttctgccgcttcagtggggccgctgcgggagacagcgggtggatcctccagcagcctgtctgctgagcctgccttctcaagtctactgttaaaatcaggaccgggtcgtgtccgagcctacaggccctgtctccgctccccaggcctgcaggagttgagggctgcacctgctcgctggagagggagaggcagatttagtggacgcctggcatggactcggactggcctttggaagctccctgccctgacggggttgcctgtcaccactgcgaagtgaggcttggcaggacctgcacctgagaaaggctgtgtgtggtcttggggtccacacctgcagagctaacttactgccagacggcgacttactgtgggccaccctcagtgaaccggggtgtcctcagctggccctacagagcacttctgtgctggggatgagtaggaactctgggcgaggagggtcccagcgccgcccctcgatacagcctggctctgccctctgcccgtacttataccaggtgggatccctgccctgcattgcctggggattggctgggcttgggcccgccctgctgtggaactggatgttttcagggagcccagcctttcctcatgtcaacacagttcacaatatagttttcaaagtacagtttaaaactcaaaagtaaacttttcagcaactcaaaggtttgctgagtgatctgaagcactctggccactttttggggccatgggatttggttcacctgaaacagccagtgagaggccgggtgtggtggctcacacccgtaatcccaacacttcaggaggcagacgcgggtgatcgctcacttgagatcaggagttcaagaccagcctgggcaacatggtgaaacctcgtctctactaaaaatacaaaaattagctaggcatggtggtgggcacctgtaatcccagctacttggaaggctgaggcaagagaatcgcttgaacctgggaggtggaggttgcagcgagacgagattacgccgctgcactccagcctgggtgacgagagactctgcctcaaaaaaataaaaaaatgaaacagccagtgaggaggaaggctccccgccttccccccgccggaacatagccatagctgctgctgggacaccctcttggtggggaag

SEQ ID NO: 286311 - DNA, 1079 bp, Homo sapiens
cgcgaccctcctggccccgtgtccgggtctggcgggcaggcgagcggccacacggggacgcgagggcagctggataccgtggggagggggtgccctatggacggggtgtgcctgtctggccagcagggacggcgggtgggggtaagcgaaatcattcgggggctttgctgccctccgcttggtggggctgaggctgggccagataccctcttggagggaactttcttttccttgtgtgtccagggtaccagtgtgcggagttcctgttgccaagctgaaggtggccctgggcaggcacaggtgtggtcatatcttcagccaacaggaccatcctccggagggccacctctggggacttcctacgggaagagagtgacagatttggtgcttctgtgtgtttctgccgcttcagtggggccgctgcgggagacagcgggtggatcctccagcagcctgtctgctgagcctgccttctcaagtctactgttaaaatcaggaccgggtcgtgtccgagcctacaggccctgtctccgctccccaggcctgcaggagttgagggctgcacctgctcgctggagagggagaggcagatttagtggacgcctggcatggactcggactggcctttggaagctccctgccctgacggggttgcctgtcaccactgcgaagtgaggcttggcaggacctgcacctgagaaaggctgtgtgtggtcttggggtccacacctgcagagctaacttactgccagacggcgacttactgtgggccaccctcagtgaaccggggtgtcctcagctggccctacagagcacttctgtgctggggatgagtaggaactctgggcgaggagggtcccagcgccgcccctcgatacagcctggctctgccctctgcccgtacttataccaggtgggatccctgccctgcattgcctggggattggctgggcttgggcccgccctgctgtggaactggatgttttcagggagcccagcctttcctcatgtcaacacagttcacaatatagttttcaaagtacagtttaaaactcaaaagtaaacttttcagcaactca

SEQ ID NO: 286312 - DNA, 915 bp, Homo sapiens
agcggccgcagctgaagttgggccgagagccggcgacggccccgcgccggggtcgcaggtgacgcgcgagggatcccagggtaccagtgtgcggagttcctgttgccaagctgaaggtggccctgggcaggcacaggtgtggtcatatcttcagccaacaggaccatcctccggagggccacctctggggacttcctacgggaagagagtgacagatttggtgcttctgtgtgtttctgccgcttcagtggggccgctgcgggagacagcgggtggatcctccagcagcctgtctgctgagcctgccttctcaagtctactgttaaaatcaggaccgggtcgtgtccgagcctacaggccctgtctccgctccccaggcctgcaggagttgagggctgcacctgctcgctggagagggagaggcagatttagtggacgcctggcatggactcggactggcctttggaagctccctgccctgacggggttgcctgtcaccactgcgaagtgaggcttggcaggacctgcacctgagaaaggctgtgtgtggtcttggggtccacacctgcagagctaacttactgccagacggcgacttactgtgggccaccctcagtgaaccggggtgtcctcagctggccctacagagcacttctgtgctggggatgagtaggaactctgggcgaggagggtcccagcgccgcccctcgatacagcctggctctgccctctgcccgtacttataccaggtgggatccctgccctgcattgcctggggattggctgggcttgggcccgccctgctgtggaactggatgttttcagggagcccagcctttcctcatgtcaacacagttcacaatatagttttcaaagtacagtttaaaactcaaaagtaaacttttcagcaactca

SEQ ID NO: 286313 - DNA, 894 bp, Homo sapiens
agcggccgcagctgaagttgggccgagagccggcgacggccccgcgccggggtcgcagggtaccagtgtgcggagttcctgttgccaagctgaaggtggccctgggcaggcacaggtgtggtcatatcttcagccaacaggaccatcctccggagggccacctctggggacttcctacgggaagagagtgacagatttggtgcttctgtgtgtttctgccgcttcagtggggccgctgcgggagacagcgggtggatcctccagcagcctgtctgctgagcctgccttctcaagtctactgttaaaatcaggaccgggtcgtgtccgagcctacaggccctgtctccgctccccaggcctgcaggagttgagggctgcacctgctcgctggagagggagaggcagatttagtggacgcctggcatggactcggactggcctttggaagctccctgccctgacggggttgcctgtcaccactgcgaagtgaggcttggcaggacctgcacctgagaaaggctgtgtgtggtcttggggtccacacctgcagagctaacttactgccagacggcgacttactgtgggccaccctcagtgaaccggggtgtcctcagctggccctacagagcacttctgtgctggggatgagtaggaactctgggcgaggagggtcccagcgccgcccctcgatacagcctggctctgccctctgcccgtacttataccaggtgggatccctgccctgcattgcctggggattggctgggcttgggcccgccctgctgtggaactggatgttttcagggagcccagcctttcctcatgtcaacacagttcacaatatagttttcaaagtacagtttaaaactcaaaagtaaacttttcagcaactca

SEQ ID NO: 286314 - DNA, 821 bp, Homo sapiens
agcggccgcagctgaagttgggccgagagccggcgacggccccgcgccggggtcgcagggtaccagtgtgcggagttcctgttgccaagctgaaggtggccctgggcaggcacaggtgtggtcatatcttcagccaacaggaccatcctccggagggccacctctggggacttcctacgggaagagagtgacagatttggtgcttctgtgtgtttctgccgcttcagtggggccgctgcgggagacagcgggtggatcctccagcagcctgtctgctgagcctgccttctcaagtctactgttaaaatcaggaccgggtcgtgtccgagcctacaggccctgtctccgctccccaggcctgcaggagttgagggctgcacctgctcgctggagagggagaggcagatttagtggacgcctggcatggactcggactggcctttggaagctccctgccctgacggggttgcctgtcaccactgcgaagtgaggcttggcaggacctgcacctgagaaaggctgtgtgtggtcttggggtccacacctgcagagctaacttactgccagacggcgacttactgtgggccaccctcagtgaaccggggtgtcctcagctggccctacagagcacttctgtgctggggatgagtaggaactctgggcgaggagggtcccagcgccgcccctcgatacagcctggctctgccctctgcccgtacttataccaggtgtggtcatatcttcagccaacaggaccatcctccggagggccacctctggggacttcctacgggaagagagtgacagatttggtgcttctg

SEQ ID NO: 286315 - DNA, 929 bp, Homo sapiens
  misc_feature (904)..(904): n is a, c, g, or t
tactatctcctatatcgcttgctgtctttctaggacaagaacatgtactctcataaagggcagatccctcagacgggtggtagagatgagtgacgtctgaccctcgctgctgcctgtcgcgggagaggaacaagctttcgactagcgcctctccccggggcccgcgccccgagccccacgcgcaagacagcccaacagctgttcctcccctccccgccgactccaactcttcggaatctgcccactcggggctgcagggcaagtgtttaggatggttcccagccccgcgctggcggtgaaaatttcaacgtcattccttcaattaaaaaaaggggggggggcaagggaggggctttgtgataactactcccagcttcttctgatcatttcaaaattaagtcgattttttttaaccagtccccacttactgtcctaactctcctcgctgaccctatctgggagcccggaaccgttaggtactgccgaatgcggtgcaaaatttccccctctcccccagttcgcagtgcctggagccgctggggttactcgtctgttctgatgccaccgcgagatggtccccgagctccccgagagtcctcagtgaaaggattccgcggcactgcctctattattataccgtaaatctttttaaattctggaactaattatatagaggatatgtctcaatttgttctgcattaatgccacagtggggatggaggccaggccgtggccagagcagatacgtaggcccatgaaattgatgaactgagagttgcttccagtcctgagcgcaccatctggaattccagtctgaggttacaattagaactcctgaccccagattcaactttgcaaacaacaggggaaaaaaatggggaaaagaaaaaccacgagagagggnaaaaaaattattctgcacctgtaaa

SEQ ID NO: 286316 - DNA, 6013 bp, Homo sapiens
  misc_feature (1)..(1): n is a, c, g, or t
  misc_feature (4)..(4): n is a, c, g, or t
  misc_feature (7)..(7): n is a, c, g, or t
  misc_feature (472)..(472): n is a, c, g, or t
  misc_feature (1081)..(1081): n is a, c, g, or t
  misc_feature (2062)..(2062): n is a, c, g, or t
  misc_feature (2161)..(2161): n is a, c, g, or t
  misc_feature (2314)..(2314): n is a, c, g, or t
  misc_feature (2372)..(2372): n is a, c, g, or t
  misc_feature (3197)..(3197): n is a, c, g, or t
  misc_feature (3323)..(3324): n is a, c, g, or t
  misc_feature (3339)..(3339): n is a, c, g, or t
  misc_feature (3341)..(3341): n is a, c, g, or t
  misc_feature (3455)..(3455): n is a, c, g, or t
  misc_feature (3472)..(3472): n is a, c, g, or t
  misc_feature (3618)..(3618): n is a, c, g, or t
  misc_feature (5988)..(5988): n is a, c, g, or t
natncgngggagctatccacggacacgacgctgttccagaaagccatttagttactggaggtgcatgtgctcattctagttctctacgatacttaatgtgcacctaagtgtgtgccaacaccgtattataagggctggaggtgctcctggacattttagcgctgcggaggcagcacagcacaggcgctcacccccgcgctggtcccactccgaatccagagtccagacgtctgaaaagcgctacgcttggtgacaatttggcgtttccttaattaacaaaactctccccaaggcagagccagacactgcgccggtctcctggttccactcccgtggggactagcagtcccggaatctctcggactctaaggggccccagacgccctcccggctcttgcgaacagtcaggctcctagctctgcctggctttggaggatgtcgggggccagtgcctgcgtgcactcccactctncggcctcctccccagccgccgcttccgctatcctcacggcccttgggaagcagctgggtaagagctgcggtcaaaaggggtaggagaggggggtgtcctagagcggagagtccctggcgccactgccccgcgcgtagggggcgctccccggcctacttaccctgattgcgaatagcgggctggctctcgaggcagctgggcaggtagggcgcgttaggaaacatcctggcctggccggatgacgcctggctgggcggaggaggaccgaagggcccgtagcgacaggctccggctgtgccagtgaactggccggaaaagtggacagtgaaggcgctcaggcactgctcctcgtgcggctccgcgccgccccagctcggctcctgtttgatgaaggagtgaggcggcggcggcgggggtggcggcggagccggtggcggcgcggggccgcccaacgacccgtaagccgaagcgcccgggggcgcaaagtccagcaccggcgcccactgcgccgcgccgctcacaggcagggcacagccgccgccgccacccagggaggggacggcgggcagcagcgcgttcaggtcccgcacgtcggagcccatttgctgnggctcagacccggacgccccgcggctcctccggccctggagacgttcagcgctggcctcggcggcgcctaacttggcccagatgccgcccgggtcccggactccctgctgctctggctgctgtaggcacccaggcccggagcggagcgtgtgctgagacgccggctccgggacacacgtggaagccgggtcctgcagcaagaggaagtccaggatcgcggcgaggagacggcggggcccgggcgcctgggctgccgtcccggctctgggtgggtgggtgggtgaatgagtaggtgggagggagggcgggaagtgggggagcggacaggcggtcgggttgcggagagcccccgggtgtgggcgctgccttgaactccttaccccagctgcctggctgccctcagcttcccaaagctcaaataagaggggccggcggcgcggggaggaggaggagccaggaggctcggccgctccattcactcagcagcccaagcccggccaggcagcgcgcgctgctccttgggggcgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcaggtaagcagtgagtccgggcagggtcgaatgcggtgggagtagagatggggttgttaatctaaaagagtggtttggagggaggggcaggtaggctccaagagggcgggaacttcaggaaagcgcagaaagaactcagtcaagcttcaaagaagcgtatacccttgctttgcacccttgagtctggctcttgcttctagaactgtcgggtaggggagtggccatgatcttggggtcactggggaaagaggtggccctttgtgggttccagaggtcgggactgaangcgaacgtccctcagttgggtggccgggagttgcaccagttataagccgggcgtatttcgatcggctagtagttgtttacttggtgaggtttgcgccangcggaaggcggttgccgcctacctaaaattggagtcagcagcacttagtttccctttccagtgaggaatatctaattcttctacggttaagccgggaaaacagcggctagtttaggagggaagaaaacccttgggcaaacgcccaaagcctgngtatattccggccggagcatcctggcgcccagtttggggaggaggggtgaaggggagngtttggatacgaagcccggcagggagcgggtaactcctggagccactccgccgagcactgcctgtggccctggtcgaggataccattctggttgctcagtgattgaccaggaggcggaagccagttaaggggaccaaggagtggagtagggagaacctccatcggcccacgggcgcgagttagtgttcgaatctttgggagctcgaagagcttcgctaaatctgactcccttcatctagtctctgtttggcagcccccgcgccccagagcaggtgtttggggcgggtagggggtgttgttttggtttggtttttggatcttctaaaggagtcagtatctattgggaaacaacccctaggcaaggagaagaaccgggggccggagcggagcgtgtttcagaggtgcgtataaaatcccaggggcgccaggaggcagcagcgacggcgcagcgtgggacggccaggcgcgacgggagggaagcaaccggttgcagtccggcctcctgtacctggctggcccgggctagggctgcaagctttccagccaaacttatgtgaagcaaagtagttgcagtttgacaaagaatggcgtttcaataaatgacatagtaattttttacgctttggtttttagcttgcattgcataaacgttgtcgccattaaattctggctgcggacccgaagtgtgtgcgggcccaggacttactcgaagggcgcacttcttgggaatgcgcatcccgtaggcgcaggagaccctgagggtaaagatgcggcacttgagccctccgcttgcctcccaggccacctttgctgcttgactttgcntcgtctccactcagaagcttttaaaattattattaagaaaagaaagattctacaagacactgcccccacgctctctgctcagtcctctcccacacgatctatccctaaacctttcgcggggctcgnncgtttggttttttgngnggagaaaggactctcgagacaaaattcactgccagttgccctaagaaccccccagatccctgtatctcccttccttctccccgcctattatttctacttggaagtcgtttttcntaactaggactcaactntgaggggcgaggagccctttatgaaaagccggggactttcatttccaaacgaaaagattgagattgtttcttcttttaccatccttggcacttttagcggggggagaggaggttatctgaagggaggctggcttgaatgtgagtcnttgtgtttgtgaaacccaggtaaggcaaagacacgtaaatctctgccaacatttttcaaaaataagtttttgccccggggtgagggatgtaggggtggataggaggaaaggagagccaagcaaatgtagaactcctctctcctctgccatttattttctcagaatccttgtgggggcggggaggggaagagcaccggtgcgaaccccggggtgccccctcgcccgacttggacttctccgactaaagaggtgggaggagttccctgcagcctgcggggccaagaagaaagtgctaagctgaggagccgcagtcggaggaccccagggacccgacaggaagtctccgtacgaccccaacggatccacatgcccggaagcccaggcgacactaagccagcgctggggaactgacgtactcctgcagtcgcagggcgctccatgcctctctgtcctcttctttgttgtgggtaacgttctctgcgggagacctgaggttttccaagggggacatgccagctacactggccttggcgccctgagctaagcaccaggactcacagcctagcacgaaggcaggtagcaccttcacccgccgcggacgataggcgctctcctgtacctcctttagctcgcgaggcccgcccttcgcgaggtcccagagaaaagcaggctgtggaaaactgggcgcccccttctttcacccaccttcttacccctgtcagcgccgagatctgtagcagaggttcctggtctgaaccaccgattggcaaagaaagctgcagattaaacttctcgttttacagagaaggaaactgaggcccagacagccgaaggagaggcagtctatggagcgcagcggtaaagagcaaggggttggtggccccagaatggaacctcagctctgccaggtaaccaacagctgtgtgaccctagacgagttccgcagtctctctgagcctcagtttccttactggtcaaacgggataatgggatactagcgcccacctcatagagttgttctgaggattagataggagagcagtgtgggcctttgactcaatcaactttacagtttttgttactactactgtttaaggacaggaaacaagttagtggcaacgccgagctgaaacccgggtctctcaacgtccagttggaggttttacccaccacccctctacctcttcagagctaatgggatgcagaggcgaggacagcccctggaaaaccatgtggcgttgatacactggcaaagcgcaggcatcccggcctcgaaggtgcataattattgcaatatgaaaaaatcgaggctgggtaggagcagggcagtgaggatttctcaacccttactttcaccccggcgctgtccactgcatctgacagagcgcggagctgggctgctacagccgcaaccccagggaccagtgcgcacgcctgggccgccctccgggagtcacccagcggccgcggacaactgaataaacaccccaaagcgctgcggtcggtcaagggcggggacagccacactgcgcgcggggcccgcaggccgtaataaagagtggctcgacctcgctgctgcctgtcgcgggagaggaacaagctttcgactagcgcctctccccggggcccgcgccccgagccccacgcgcaagacagcccaacagctgttcctcccctccccgccgactccaactcttcggaatctgcccactcggggctgcagggcaagtgtttaggatggttcccagccccgcgctggcggtgaaaatttcaacgtcattccttcaattaaaaaaaggggggggggcaagggaggggctttgtgataactactcccagcttcttctgatcatttcaaaattaagtcgattttttttaaccagtccccacttactgtcctaactctcctcgctgaccctatctgggagcccggaaccgttaggtactgccgaatgcggtgcaaaatttccccctctcccccagttcgcagtgcctggagccgctggggttactcgtctgttctgatgccaccgcgagatggtccccgagctccccgagagtcctcagtgaaaggattccgcggcactgcctctattattataccgtaaatctttttaaattctggaactaattatatagaggatatgtctcaatttgttctgcattaatgccacagtggggatggaggccaggccgtggccagagcagatacgtaggcccatgaaattgatgaactgagagttgcttccagtcctgagcgcaccatctggaattccagtctgaggttacaattagaactcctgaccccagattcaactttgcaaacaacaggggaaaaaaatggggaaaagaaaaaccacgagagagggnaaaaaaattattctgcacctgtaaa

SEQ ID NO: 286317 - DNA, 4012 bp, Homo sapiens
  misc_feature (1)..(1): n is a, c, g, or t
  misc_feature (4)..(4): n is a, c, g, or t
  misc_feature (7)..(7): n is a, c, g, or t
  misc_feature (472)..(472): n is a, c, g, or t
  misc_feature (1081)..(1081): n is a, c, g, or t
  misc_feature (3987)..(3987): n is a, c, g, or t
natncgngggagctatccacggacacgacgctgttccagaaagccatttagttactggaggtgcatgtgctcattctagttctctacgatacttaatgtgcacctaagtgtgtgccaacaccgtattataagggctggaggtgctcctggacattttagcgctgcggaggcagcacagcacaggcgctcacccccgcgctggtcccactccgaatccagagtccagacgtctgaaaagcgctacgcttggtgacaatttggcgtttccttaattaacaaaactctccccaaggcagagccagacactgcgccggtctcctggttccactcccgtggggactagcagtcccggaatctctcggactctaaggggccccagacgccctcccggctcttgcgaacagtcaggctcctagctctgcctggctttggaggatgtcgggggccagtgcctgcgtgcactcccactctncggcctcctccccagccgccgcttccgctatcctcacggcccttgggaagcagctgggtaagagctgcggtcaaaaggggtaggagaggggggtgtcctagagcggagagtccctggcgccactgccccgcgcgtagggggcgctccccggcctacttaccctgattgcgaatagcgggctggctctcgaggcagctgggcaggtagggcgcgttaggaaacatcctggcctggccggatgacgcctggctgggcggaggaggaccgaagggcccgtagcgacaggctccggctgtgccagtgaactggccggaaaagtggacagtgaaggcgctcaggcactgctcctcgtgcggctccgcgccgccccagctcggctcctgtttgatgaaggagtgaggcggcggcggcgggggtggcggcggagccggtggcggcgcggggccgcccaacgacccgtaagccgaagcgcccgggggcgcaaagtccagcaccggcgcccactgcgccgcgccgctcacaggcagggcacagccgccgccgccacccagggaggggacggcgggcagcagcgcgttcaggtcccgcacgtcggagcccatttgctgnggctcagacccggacgccccgcggctcctccggccctggagacgttcagcgctggcctcggcggcgcctaacttggcccagatgccgcccgggtcccggactccctgctgctctggctgctgtaggcacccaggcccggagcggagcgtgtgctgagacgccggctccgggacacacgtggaagccgggtcctgcagcaagaggaagtccaggatcgcggcgaggagacggcggggcccgggcgcctgggctgccgtcccggctctgggtgggtgggtgggtgaatgagtaggtgggagggagggcgggaagtgggggagcggacaggcggtcgggttgcggagagcccccgggtgtgggcgctgccttgaactccttaccccagctgcctggctgccctcagcttcccaaagctcaaataagaggggccggcggcgcggggaggaggaggagccaggaggctcggccgctccattcactcagcagcccaagcccggccaggcagcgcgcgctgctccttgggggcgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcagaatccttgtgggggcggggaggggaagagcaccggtgcgaaccccggggtgccccctcgcccgacttggacttctccgactaaagaggtgggaggagttccctgcagcctgcggggccaagaagaaagtgctaagctgaggagccgcagtcggaggaccccagggacccgacaggaagtctccgtacgaccccaacggatccacatgcccggaagcccaggcgacactaagccagcgctggggaactgacgtactcctgcagtcgcagggcgctccatgcctctctgtcctcttctttgttgtgggtaacgttctctgcgggagacctgaggttttccaagggggacatgccagctacactggccttggcgccctgagctaagcaccaggactcacagcctagcacgaaggcaggtagcaccttcacccgccgcggacgataggcgctctcctgtacctcctttagctcgcgaggcccgcccttcgcgaggtcccagagaaaagcaggctgtggaaaactgggcgcccccttctttcacccaccttcttacccctgtcagcgccgagatctgtagcagaggttcctggtctgaaccaccgattggcaaagaaagctgcagattaaacttctcgttttacagagaaggaaactgaggcccagacagccgaaggagaggcagtctatggagcgcagcggtaaagagcaaggggttggtggccccagaatggaacctcagctctgccaggtaaccaacagctgtgtgaccctagacgagttccgcagtctctctgagcctcagtttccttactggtcaaacgggataatgggatactagcgcccacctcatagagttgttctgaggattagataggagagcagtgtgggcctttgactcaatcaactttacagtttttgttactactactgtttaaggacaggaaacaagttagtggcaacgccgagctgaaacccgggtctctcaacgtccagttggaggttttacccaccacccctctacctcttcagagctaatgggatgcagaggcgaggacagcccctggaaaaccatgtggcgttgatacactggcaaagcgcaggcatcccggcctcgaaggtgcataattattgcaatatgaaaaaatcgaggctgggtaggagcagggcagtgaggatttctcaacccttactttcaccccggcgctgtccactgcatctgacagagcgcggagctgggctgctacagccgcaaccccagggaccagtgcgcacgcctgggccgccctccgggagtcacccagcggccgcggacaactgaataaacaccccaaagcgctgcggtcggtcaagggcggggacagccacactgcgcgcggggcccgcaggccgtaataaagagtggctcgacctcgctgctgcctgtcgcgggagaggaacaagctttcgactagcgcctctccccggggcccgcgccccgagccccacgcgcaagacagcccaacagctgttcctcccctccccgccgactccaactcttcggaatctgcccactcggggctgcagggcaagtgtttaggatggttcccagccccgcgctggcggtgaaaatttcaacgtcattccttcaattaaaaaaaggggggggggcaagggaggggctttgtgataactactcccagcttcttctgatcatttcaaaattaagtcgattttttttaaccagtccccacttactgtcctaactctcctcgctgaccctatctgggagcccggaaccgttaggtactgccgaatgcggtgcaaaatttccccctctcccccagttcgcagtgcctggagccgctggggttactcgtctgttctgatgccaccgcgagatggtccccgagctccccgagagtcctcagtgaaaggattccgcggcactgcctctattattataccgtaaatctttttaaattctggaactaattatatagaggatatgtctcaatttgttctgcattaatgccacagtggggatggaggccaggccgtggccagagcagatacgtaggcccatgaaattgatgaactgagagttgcttccagtcctgagcgcaccatctggaattccagtctgaggttacaattagaactcctgaccccagattcaactttgcaaacaacaggggaaaaaaatggggaaaagaaaaaccacgagagagggnaaaaaaattattctgcacctgtaaa

SEQ ID NO: 286318 - DNA, 3731 bp, Homo sapiens
  misc_feature (1)..(1): n is a, c, g, or t
  misc_feature (4)..(4): n is a, c, g, or t
  misc_feature (7)..(7): n is a, c, g, or t
  misc_feature (472)..(472): n is a, c, g, or t
  misc_feature (1081)..(1081): n is a, c, g, or t
  misc_feature (3706)..(3706): n is a, c, g, or t
natncgngggagctatccacggacacgacgctgttccagaaagccatttagttactggaggtgcatgtgctcattctagttctctacgatacttaatgtgcacctaagtgtgtgccaacaccgtattataagggctggaggtgctcctggacattttagcgctgcggaggcagcacagcacaggcgctcacccccgcgctggtcccactccgaatccagagtccagacgtctgaaaagcgctacgcttggtgacaatttggcgtttccttaattaacaaaactctccccaaggcagagccagacactgcgccggtctcctggttccactcccgtggggactagcagtcccggaatctctcggactctaaggggccccagacgccctcccggctcttgcgaacagtcaggctcctagctctgcctggctttggaggatgtcgggggccagtgcctgcgtgcactcccactctncggcctcctccccagccgccgcttccgctatcctcacggcccttgggaagcagctgggtaagagctgcggtcaaaaggggtaggagaggggggtgtcctagagcggagagtccctggcgccactgccccgcgcgtagggggcgctccccggcctacttaccctgattgcgaatagcgggctggctctcgaggcagctgggcaggtagggcgcgttaggaaacatcctggcctggccggatgacgcctggctgggcggaggaggaccgaagggcccgtagcgacaggctccggctgtgccagtgaactggccggaaaagtggacagtgaaggcgctcaggcactgctcctcgtgcggctccgcgccgccccagctcggctcctgtttgatgaaggagtgaggcggcggcggcgggggtggcggcggagccggtggcggcgcggggccgcccaacgacccgtaagccgaagcgcccgggggcgcaaagtccagcaccggcgcccactgcgccgcgccgctcacaggcagggcacagccgccgccgccacccagggaggggacggcgggcagcagcgcgttcaggtcccgcacgtcggagcccatttgctgnggctcagacccggacgccccgcggctcctccggccctggagacgttcagcgctggcctcggcggcgcctaacttggcccagatgccgcccgggtcccggactccctgctgctctggctgctgtaggcacccaggcccggagcggagcgtgtgctgagacgccggctccgggacacacgtggaagccgggtcctgcagcaagaggaagtccaggatcgcggcgaggagacggcggggcccgggcgcctgggctgccgtcccggctctgggtgggtgggtgggtgaatgagtaggtgggagggagggcgggaagtgggggagcggacaggcggtcgggttgcggagagcccccgggtgtgggcgctgccttgaactccttaccccagctgcctggctgccctcagcttcccaaagctcaaataagaggggccggcggcgcggggaggaggaggagccaggaggctcggccgctccattcactcagcagcccaagcccggccaggcagcgcgcgctgctccttgggggcgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcagaatccttgtgggggcggggaggggaagagcaccggtgcgaaccccggggtgccccctcgcccgacttggacttctccgactaaagaggtgggaggagttccctgcagcctgcggggccaagaagaaagtgctaagctgaggagccgcagtcggaggaccccagggacccgacaggaagtctccgtacgaccccaacggatccacatgcccggaagcccaggcgacactaagccagcgctggggaactgacgtactcctgcagtcgcagggcgctccatgcctctctgtcctcttctttgttgtgggtaacgttctctgcgggagacctgaggttttccaagggggacatgccagctacactggccttggcgccctgagctaagcaccaggactcacagcctagcacgaaggcaggtagcaccttcacccgccgcggacgataggcgctctcctgtacctcctttagctcgcgaggcccgcccttcgcgaggtcccagagaaaagcaggctgtggaaaactgggcgcccccttctttcacccaccttcttacccctgtcagcgccgagatctgtagcagaggttcctggtctgaaccaccgattggcaaagaaagctgcagattaaacttctcgttttacagagaaggaaactgaggcccagacagccgaaggagaggcagtctatggagcgcagcggtaaagagcaaggggttggtggccccagaatggaacctcagctctgccagagctaatgggatgcagaggcgaggacagcccctggaaaaccatgtggcgttgatacactggcaaagcgcaggcatcccggcctcgaaggtgcataattattgcaatatgaaaaaatcgaggctgggtaggagcagggcagtgaggatttctcaacccttactttcaccccggcgctgtccactgcatctgacagagcgcggagctgggctgctacagccgcaaccccagggaccagtgcgcacgcctgggccgccctccgggagtcacccagcggccgcggacaactgaataaacaccccaaagcgctgcggtcggtcaagggcggggacagccacactgcgcgcggggcccgcaggccgtaataaagagtggctcgacctcgctgctgcctgtcgcgggagaggaacaagctttcgactagcgcctctccccggggcccgcgccccgagccccacgcgcaagacagcccaacagctgttcctcccctccccgccgactccaactcttcggaatctgcccactcggggctgcagggcaagtgtttaggatggttcccagccccgcgctggcggtgaaaatttcaacgtcattccttcaattaaaaaaaggggggggggcaagggaggggctttgtgataactactcccagcttcttctgatcatttcaaaattaagtcgattttttttaaccagtccccacttactgtcctaactctcctcgctgaccctatctgggagcccggaaccgttaggtactgccgaatgcggtgcaaaatttccccctctcccccagttcgcagtgcctggagccgctggggttactcgtctgttctgatgccaccgcgagatggtccccgagctccccgagagtcctcagtgaaaggattccgcggcactgcctctattattataccgtaaatctttttaaattctggaactaattatatagaggatatgtctcaatttgttctgcattaatgccacagtggggatggaggccaggccgtggccagagcagatacgtaggcccatgaaattgatgaactgagagttgcttccagtcctgagcgcaccatctggaattccagtctgaggttacaattagaactcctgaccccagattcaactttgcaaacaacaggggaaaaaaatggggaaaagaaaaaccacgagagagggnaaaaaaattattctgcacctgtaaa

SEQ ID NO: 286319 - DNA, 5062 bp, Homo sapiens
  misc_feature (1)..(1): n is a, c, g, or t
  misc_feature (4)..(4): n is a, c, g, or t
  misc_feature (7)..(7): n is a, c, g, or t
  misc_feature (472)..(472): n is a, c, g, or t
  misc_feature (1081)..(1081): n is a, c, g, or t
  misc_feature (2246)..(2246): n is a, c, g, or t
  misc_feature (2372)..(2373): n is a, c, g, or t
  misc_feature (2388)..(2388): n is a, c, g, or t
  misc_feature (2390)..(2390): n is a, c, g, or t
  misc_feature (2504)..(2504): n is a, c, g, or t
  misc_feature (2521)..(2521): n is a, c, g, or t
  misc_feature (2667)..(2667): n is a, c, g, or t
  misc_feature (5037)..(5037): n is a, c, g, or t
natncgngggagctatccacggacacgacgctgttccagaaagccatttagttactggaggtgcatgtgctcattctagttctctacgatacttaatgtgcacctaagtgtgtgccaacaccgtattataagggctggaggtgctcctggacattttagcgctgcggaggcagcacagcacaggcgctcacccccgcgctggtcccactccgaatccagagtccagacgtctgaaaagcgctacgcttggtgacaatttggcgtttccttaattaacaaaactctccccaaggcagagccagacactgcgccggtctcctggttccactcccgtggggactagcagtcccggaatctctcggactctaaggggccccagacgccctcccggctcttgcgaacagtcaggctcctagctctgcctggctttggaggatgtcgggggccagtgcctgcgtgcactcccactctncggcctcctccccagccgccgcttccgctatcctcacggcccttgggaagcagctgggtaagagctgcggtcaaaaggggtaggagaggggggtgtcctagagcggagagtccctggcgccactgccccgcgcgtagggggcgctccccggcctacttaccctgattgcgaatagcgggctggctctcgaggcagctgggcaggtagggcgcgttaggaaacatcctggcctggccggatgacgcctggctgggcggaggaggaccgaagggcccgtagcgacaggctccggctgtgccagtgaactggccggaaaagtggacagtgaaggcgctcaggcactgctcctcgtgcggctccgcgccgccccagctcggctcctgtttgatgaaggagtgaggcggcggcggcgggggtggcggcggagccggtggcggcgcggggccgcccaacgacccgtaagccgaagcgcccgggggcgcaaagtccagcaccggcgcccactgcgccgcgccgctcacaggcagggcacagccgccgccgccacccagggaggggacggcgggcagcagcgcgttcaggtcccgcacgtcggagcccatttgctgnggctcagacccggacgccccgcggctcctccggccctggagacgttcagcgctggcctcggcggcgcctaacttggcccagatgccgcccgggtcccggactccctgctgctctggctgctgtaggcacccaggcccggagcggagcgtgtgctgagacgccggctccgggacacacgtggaagccgggtcctgcagcaagaggaagtccaggatcgcggcgaggagacggcggggcccgggcgcctgggctgccgtcccggctctgggtgggtgggtgggtgaatgagtaggtgggagggagggcgggaagtgggggagcggacaggcggtcgggttgcggagagcccccgggtgtgggcgctgccttgaactccttaccccagctgcctggctgccctcagcttcccaaagctcaaataagaggggccggcggcgcggggaggaggaggagccaggaggctcggccgctccattcactcagcagcccaagcccggccaggcagcgcgcgctgctccttgggggcgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcaggcaaggagaagaaccgggggccggagcggagcgtgtttcagaggtgcgtataaaatcccaggggcgccaggaggcagcagcgacggcgcagcgtgggacggccaggcgcgacgggagggaagcaaccggttgcagtccggcctcctgtacctggctggcccgggctagggctgcaagctttccagccaaacttatgtgaagcaaagtagttgcagtttgacaaagaatggcgtttcaataaatgacatagtaattttttacgctttggtttttagcttgcattgcataaacgttgtcgccattaaattctggctgcggacccgaagtgtgtgcgggcccaggacttactcgaagggcgcacttcttgggaatgcgcatcccgtaggcgcaggagaccctgagggtaaagatgcggcacttgagccctccgcttgcctcccaggccacctttgctgcttgactttgcntcgtctccactcagaagcttttaaaattattattaagaaaagaaagattctacaagacactgcccccacgctctctgctcagtcctctcccacacgatctatccctaaacctttcgcggggctcgnncgtttggttttttgngnggagaaaggactctcgagacaaaattcactgccagttgccctaagaaccccccagatccctgtatctcccttccttctccccgcctattatttctacttggaagtcgtttttcntaactaggactcaactntgaggggcgaggagccctttatgaaaagccggggactttcatttccaaacgaaaagattgagattgtttcttcttttaccatccttggcacttttagcggggggagaggaggttatctgaagggaggctggcttgaatgtgagtcnttgtgtttgtgaaacccaggtaaggcaaagacacgtaaatctctgccaacatttttcaaaaataagtttttgccccggggtgagggatgtaggggtggataggaggaaaggagagccaagcaaatgtagaactcctctctcctctgccatttattttctcagaatccttgtgggggcggggaggggaagagcaccggtgcgaaccccggggtgccccctcgcccgacttggacttctccgactaaagaggtgggaggagttccctgcagcctgcggggccaagaagaaagtgctaagctgaggagccgcagtcggaggaccccagggacccgacaggaagtctccgtacgaccccaacggatccacatgcccggaagcccaggcgacactaagccagcgctggggaactgacgtactcctgcagtcgcagggcgctccatgcctctctgtcctcttctttgttgtgggtaacgttctctgcgggagacctgaggttttccaagggggacatgccagctacactggccttggcgccctgagctaagcaccaggactcacagcctagcacgaaggcaggtagcaccttcacccgccgcggacgataggcgctctcctgtacctcctttagctcgcgaggcccgcccttcgcgaggtcccagagaaaagcaggctgtggaaaactgggcgcccccttctttcacccaccttcttacccctgtcagcgccgagatctgtagcagaggttcctggtctgaaccaccgattggcaaagaaagctgcagattaaacttctcgttttacagagaaggaaactgaggcccagacagccgaaggagaggcagtctatggagcgcagcggtaaagagcaaggggttggtggccccagaatggaacctcagctctgccaggtaaccaacagctgtgtgaccctagacgagttccgcagtctctctgagcctcagtttccttactggtcaaacgggataatgggatactagcgcccacctcatagagttgttctgaggattagataggagagcagtgtgggcctttgactcaatcaactttacagtttttgttactactactgtttaaggacaggaaacaagttagtggcaacgccgagctgaaacccgggtctctcaacgtccagttggaggttttacccaccacccctctacctcttcagagctaatgggatgcagaggcgaggacagcccctggaaaaccatgtggcgttgatacactggcaaagcgcaggcatcccggcctcgaaggtgcataattattgcaatatgaaaaaatcgaggctgggtaggagcagggcagtgaggatttctcaacccttactttcaccccggcgctgtccactgcatctgacagagcgcggagctgggctgctacagccgcaaccccagggaccagtgcgcacgcctgggccgccctccgggagtcacccagcggccgcggacaactgaataaacaccccaaagcgctgcggtcggtcaagggcggggacagccacactgcgcgcggggcccgcaggccgtaataaagagtggctcgacctcgctgctgcctgtcgcgggagaggaacaagctttcgactagcgcctctccccggggcccgcgccccgagccccacgcgcaagacagcccaacagctgttcctcccctccccgccgactccaactcttcggaatctgcccactcggggctgcagggcaagtgtttaggatggttcccagccccgcgctggcggtgaaaatttcaacgtcattccttcaattaaaaaaaggggggggggcaagggaggggctttgtgataactactcccagcttcttctgatcatttcaaaattaagtcgattttttttaaccagtccccacttactgtcctaactctcctcgctgaccctatctgggagcccggaaccgttaggtactgccgaatgcggtgcaaaatttccccctctcccccagttcgcagtgcctggagccgctggggttactcgtctgttctgatgccaccgcgagatggtccccgagctccccgagagtcctcagtgaaaggattccgcggcactgcctctattattataccgtaaatctttttaaattctggaactaattatatagaggatatgtctcaatttgttctgcattaatgccacagtggggatggaggccaggccgtggccagagcagatacgtaggcccatgaaattgatgaactgagagttgcttccagtcctgagcgcaccatctggaattccagtctgaggttacaattagaactcctgaccccagattcaactttgcaaacaacaggggaaaaaaatggggaaaagaaaaaccacgagagagggnaaaaaaattattctgcacctgtaaa

SEQ ID NO: 286320 - DNA, 565 bp, Homo sapiens
aggcttactgtagcctcaatctcccaggcttaagtgatccttccacctcagcctccgaagtagctgggaccacaggtgtcagaatacacatcaggacaatctggactaaggaaacctgaaatttaattctgaaattaattaagtaaccatgcctaagctgtaggtatgcatcatagcttctgtgatctcagaaccgtttctctgaccagcaaaagaagagatgaaaatgctcctcttgacctctatctgcactacaccagaaacgtcattgagccagtttcttctaaggagataacagaaactttctatgcaaggctgtggggggctggtaatataaggctaggaggataaagctccttactaataaacaagctgacattgaataacatggaaaaaaggcctcgttgggctctgggggggctctctgggggcgctctcctgtcgcgagggttaattgaggatccttgcttgatgcctcgttactgactggctgtgctctgccgttagggtgatgagatcactctcaggtgactctacggcggtcctccggatctgggcataacgc

SEQ ID NO: 286321 - DNA, 2064 bp, Homo sapiens
ctttactttctcttgtttacaaaatacaaatttatagctggatttgatgctgaaaatttaatacagttacctcatgtcacagataaagaacagaaatgacttgaccaagttcacattgttgtttaacggcaggaaaagcactaaagatggatagtcctgccttcctaatttgaatgctcttattctctacaggttagggtcaagttattcagtaaaacaggctatcaggaggttaagcccaaacagtgaggaaacaaattttatgatgcttgtttgactaaatgcatgcagtttacctcaagattaagggatttaaaaaaggttagaaaacagtgtaaccctatctcctggatatatctacagacttgtatttaggaattatgccaggctgttatttctaacagagctgatgatcatagatgtggcctttaaggcaggactgggtatttggttcttaaaaatgattctgtgcctgccaatcttaggaataaataatgctttcaatgatctacattctctgtctacctaaaaagtacaaagaaaaagaatatatttaatcaaagagagatgtgtcccaggtagatggtaagcaacgggaataaagtcatgatatgcccagaataaccaatgatgaatgttattagccaggtagccaccattctagtcttagtaaaataagcatcccataaatgtttatataattttaggtgtcagaatacacatcaggacaatctggactaaggaaacctgaaatttaattctgaaattaattaagtaaccatgcctaaggtgagcttgttttcttaactgtaaaatggaagtgcaacctttaactttcctcagtggctcagatgaaatactgtgaaggtacagagtaatgctatatggcacaaagcaaaaagtgctgtgcaaaagaagacagtgtgctaaatattaggaaatttctgagttccagaaaatttggatttttaagaaactatgtcatgtcaagatgtgctttggagtaacaattttcccaatattatattaagtatatactaagtatatattagaagggattatataaaaggtgttcaaaaaacaaatatcaggaaaacactaatttaagcagaatttaacaattgtttttaacttcagaatttctcagagctttgaatattatataccatgaatctccaggaaaggacaagtgagcttatgttccccaaacttatatgaccacctaatcctttttacatggaccttctcagtggagcagtgttccatagaacacacattcttactctctatttttccaaaattcctactgtttgcttcaatacaaaatcataagacactgtggctagaaattttttttcatataaacataaacgtgtactgacacatgttggtaagcattttataggttgtctattctagctttcaaataacatgactctaaatctgtaaagaccagatcactaacatagcctctttccagaaggccataatgagtacctcctcatcagatagagaatgtaccctttaagttttgtaggagtcaagtacccctttgtcttggggacagatttctgttaagacagacagaaactcttcccttgctggtccagcagcagttttcttgttccctggaccagccagaataaaaagatgacttctgccacgcatcattttgttgtttgtctaacactgaatcccaaataaaatttcattcctgattaatagatctgaccttttaaactagacaagcagcagcaacctgagatggaattgttaagagaaaaatatggtaacattcttagctaaaatactgagagaaacggagagtttaagtctactactgtctacagtacttatgtgaatgttataaaagatctgttagaaactggtggtgatggcaacaagtcctacaccagttcttaaatcctctcttatagctagtagaaaggattacaaagtttggcaaacatcttgcatgtatcaagactgttcacaggtgtctgagcaatgaataatatgtctatagattagatttaaaagctccggacgcgtggcggacgcgtg

SEQ ID NO: 286322 - DNA, 735 bp, Homo sapiens
cgataggcggctttggggtcgccccaggagtccagctgcgagagaccaatgggatttgaaaatggccttgatgattcagacggccgtgacgtcagcggggtcaagttgtcggcaggcggagcgcgcagagtggagtaacagcgccatctagcagctgcctcgggggaatattccgggaaagaaagagggaacctgcggagcctcggtcagtttggaggagtcacgtatcacacgggaaaccagcacacaagacgcaacaaaacccgacccagagaagcgtcctttacagagcgcacgggctgggagcatgtttgaaagaagacagaccagtctatttttgtggttgtttttaaataaaaggaagaaataaggggaaccgtatgtttcaaacagttatttccgtttctccatcgccttcttccaaagcgaactaaactctccaccccttcctcaggaaacggaatctggagaacaacttgtctttcctgtcgccccacatttttccttggacagagcctagggttcagactttccgaagggctggagtttggcggggaaaggactggagcccagcgccctggagtggaggagtgaggaggctagaccgtttctaaggaggcccaagcccgctgcggctagaagaccgcagaaagaaatccgccgaatttccccatccaggggtggagagagaagacgcaggggttcctgaacctccggaaaactggaaggaaatgt

SEQ ID NO: 286323 - DNA, 749 bp, Homo sapiens
agaccagaggcacccgatccccgacccgagagctgtggcctgggcctggcagggtgggcggctcctgggtcaccatctcaggggcccacaaggctttggccttggagccggttctgctgctttacttcaggccctggcggtcctcgctttccgcttgaccttgcccccgctaaaacagggaatattccgggaaagaaagagggaacctgcggagcctcggtcagtttggaggagtcacgtatcacacgggaaaccagcacacaagacgcaacaaaacccgacccagagaagcgtcctttacagagcgcacgggctgggagcatgtttgaaagaagacagaccagtctatttttgtggttgtttttaaataaaaggaagaaataaggggaaccgtatgtttcaaacagttatttccgtttctccatcgccttcttccaaagcgaactaaactctccaccccttcctcaggaaacggaatctggagaacaacttgtctttcctgtcgccccacatttttccttggacagagcctagggttcagactttccgaagggctggagtttggcggggaaaggactggagcccagcgccctggagtggaggagtgaggaggctagaccgtttctaaggaggcccaagcccgctgcggctagaagaccgcagaaagaaatccgccgaatttccccatccaggggtggagagagaagacgcaggggttcctgaacctccggaaaactggaaggaaatgt

SEQ ID NO: 286324 - DNA, 340 bp, Homo sapiens
gaaatggaggtgttctgacctatgatcagacaaggtaggtcagaaaccagctccagaaaccaggaaaaagttcctgccttggggagagaaagaaataggtgaaaggagggcagaaaaggagccctgcctgttttgctcgttgttgcctcactagcccataccagagtgcagggtgcgctgtaagccgtgaccgcatcacagatcatcagcatgcagagatggcgagtaacccatgggccaggtagcgttctatgccaaccttgaatgccatcaggaagtcactggacagcaaactcttccaagatcataacttggctgttggagcaacctggaaaagaag

SEQ ID NO: 286325 - DNA, 597 bp, Homo sapiens
cagcagcgaacaattaatatgcaacagtctcaagtagaaaaatacaaaactcttttcgaagaagcaaacaaaaagtatgatggattacagcaacagttgtcttcagtagaaagggaattagaaaataaaagaagactgcaaaaacaggctgcaagtagtcaaagtgccacagaggttcgcttgaatagagctctagaagaagcagaaaagtataaactggagttaagtaaattaaggcaaaataacaagatgcatattgaagctgccaagatgctatctttcactgaggaggaatttatgaaagcacttgaatggggaaattcataagtgatctacttcagttagtctctatgacagtatgtgatggatacccattttacttattgtagtggtttgaattatttttattcttcataagtaatatatttgattatgaaagcaaaataatttcaaagaattccctttttagatttaggagattagctattagctctttttgagttgtttttttaagttcttagcgtgacaattaagcacatcagataataaaattcttgactcttttcatttataattctcctcccttacagtagacca

SEQ ID NO: 286326 - DNA, 732 bp, Homo sapiens
cagcagcgaacaattaatatgcaacagtctcaagtagaaaaatacaaaactcttttcgaagaagcaaacaaaaagtatgatggattacagcaacagttgtcttcagtagaaagggaattagaaaataaaagaagactgcaaaaacaggctgcaagtagtcaaagtgccacagaggttcgcttgaatagagctctagaagaagcagaaaagtataaactggagttaagtaaattaaggcaaaataacaaggacatagcaaatgaagaacacaaaaaaattgaagtgttaaaatcagaaaacaagaagctagaaaaacaaaaaggagaattaatgatagggttcaagaaacagttaaaattaattgatgttttaaaaaggcaaaagatgcatattgaagctgccaagatgctatctttcactgaggaggaatttatgaaagcacttgaatggggaaattcataagtgatctacttcagttagtctctatgacagtatgtgatggatacccattttacttattgtagtggtttgaattatttttattcttcataagtaatatatttgattatgaaagcaaaataatttcaaagaattccctttttagatttaggagattagctattagctctttttgagttgtttttttaagttcttagcgtgacaattaagcacatcagataataaaattcttgactcttttcatttataattctcctcccttacagtagacca

SEQ ID NO: 286327 - DNA, 454 bp, Homo sapiens
agagaggtaattggggccctgcggttgtggtggcagcagtgaaagttggctgtcaccgactggagcgcccccagttggtgggcagggatacgggcgcgggtagtggcaggaaagttgcagggcagagagccagaacccagtcctaggtctcacctcgtggcctaaacacgcgtcagagtggtgagaccgctccctgaggagggccaggagctgccatgaagtcgccaggcattccagagggccagatcctggtgcactgagaccccagcaccaacctctggccagcccttggtgtctccacttgttcctgtttgattatgtttcccaagagccccgatgttgtcctgtttcctaaacaggatccctctgttaaatccctggacctgcacaatccccgggaaccttaacgtcctctactacaaataaaattacctatacatttgtcaaaactcat

SEQ ID NO: 286328 - DNA, 656 bp, Homo sapiens
atattcttgcagagcaggtcattgtgacaaaacaccacaggggactccagctgggacagatgctccttcagccaggccagctcccgttccaacacctctaccttagggacatctgcagaaaggctgggcagtggcaaaaaagggggccttggaaaaatggccaatctcttagaccctcacttttatcatctgtaaaatggcactgaggcgtcctgtccttctgactcctctggttatgctaggaagctgataaagacatgggcgtcaaagcatgaggcagagcataaaagtcactgactgagggcatccctgctactttgtgaaaggaacaggagggtaaggaaggagacacagggaaaggacaaggcaggtgagaacgagtgtccagacctggggattccagactaagaacaagggcaacaggagcagtggggagagatgcaaaacagacctgatcttaggatgctgggaaaactccccaggaggcggtgcagctccctaagtcgagctgactcccacaaagatcctccccaggaggaagagtagtgccctggcagggagctggagcaatggagctctcttgaggaggcagaggtatgtcctggtatgcacccccctctcaccccagcagctgaccatgtcacaggtagaaggga

SEQ ID NO: 286329 - DNA, 338 bp, Homo sapiens
atattcttgcagagcaggtcattgtgacaaaacaccacaggggactccagctgggacagatgctccttcagccaggccagctcccgttccaacacctctaccttagggacatctgcagaaaggctgggcagtggcaaaaaaggtagccagtgaaaggagggctgatagacaggtgcttggcctcaagagccctgaatctgagcctcatcactccctctgtcttactgcagggggccttggacgtcaccgttgccctgcatggtggccccagagcagcctctatgaacaacctcgtttccaaaccacagcccacagccggagagtccagaccacatgat

SEQ ID NO: 286330 - DNA, 877 bp, Homo sapiens
aggtcatgacatttcctgttgcggggaaggaggcaaaagaacaaagatgttactctcctttgatttggctgacaattcaaagactcttcattctcataggagaatataagaattcatgaacaagattcccagaattcagaggtcgattctcaagctgaagagtctgtggtttcattgccgcatggaacaggatggagtctcggtctatagcccgggctggagtacaatggcacaatctcagctcactgcaacctctgcctcctgggttcaagtgattctcctgcctcaggctcccgagtagctgggattacaggtcagaaaaaggtgcacagcaggatgtgaagatctctctgctctgagcgcgggctggttctttcgatgtcagggaacttctcaaatgagaagagatggaagaagagatttttgagggaggagagagaaagtcactttacaccagggaagaggaagagaggagactcagaatgcaagcaaacactgctgttcttcttccgcttcgttaatacgaattactgccaacaatctgctgcattcacatcttgctgggtatttaaaaatccatcccaaatttgcctcatttctgtcactcttcttggtgtgcttgtagatgaatggttatagaagtttatttgtaaaaatggtaaatattacttctctattaagatcaaattttttctcgaaagattcaacacaactaattattatgaaaataaatataattatcgtactgttgaaatacttaatataattatatgttgtgtggcgtctcaggctacttgcccctgactgtctcacccaccccttgctaacctggctgcctttttctgtgggacaaattcctccttagcttcctgaatat

SEQ ID NO: 286331 - DNA, 253 bp, Homo sapiens
acctacaagaaagaaaattcgattagtactgaaatatctgacaaggctgaataggactatttaaagaaaaccacggtagcccaagaggcgtacaaagaaatttgtgacacagcacactgaagcttatatacattagtctctgtgagctctgtcactgtgagtctgatccactcatggtctgcctggtgttctaaaggtgacatctgatgtcactgcccaccttttccacaactgcaaccaagtcttgtctcct

SEQ ID NO: 286332 - DNA, 291 bp, Homo sapiens
cctctgcccagtcttcaacccccgcctttggagtccgtggaggaaaagagcagaaacaggagcccagagaccattccagactcaccaggtaaaaaggtaaggatgaagaagacagtggtccaaggtgactcccaatgcctgaatcacatggctgcttcctgctgccacaatccactggcccactgacttgtaggggaagtaaacaggagcccctgagatcatcttaattcagaaatcttcaaatgtttctactaaatgagattaaaaaaaataaaacaagatgctgcgcga

SEQ ID NO: 286333 - DNA, 350 bp, Homo sapiens
cctctgcccagtcttcaacccccgcctttggagtccgtggaggaaaagagcagaaacaggagcccagagaccattccagactcaccagactgggatccccagggacaggacacttagggaagagcagagaggacatggcctggtcaggtaaaaaggtaaggatgaagaagacagtggtccaaggtgactcccaatgcctgaatcacatggctgcttcctgctgccacaatccactggcccactgacttgtaggggaagtaaacaggagcccctgagatcatcttaattcagaaatcttcaaatgtttctactaaatgagattaaaaaaaataaaacaagatgctgcgcga

SEQ ID NO: 286334 - DNA, 446 bp, Homo sapiens
accccatctctactaaaaatacaaaacaatgagcccaggcatggtggcacatgcctgtggtcccagctacctgggaggctgaggcaggagaatggcttgaacccgggaggcggaggttgcagtgagctgagatcacgccactgcactccagcctgggtgacagagcaagactccgtctcaagaaaaaagaaaaaaaaaaaaaggcatacatggatagcattttccaggatgtctcttaactagctatttccctttaggtaaaaaggtaaggatgaagaagacagtggtccaaggtgactcccaatgcctgaatcacatggctgcttcctgctgccacaatccactggcccactgacttgtaggggaagtaaacaggagcccctgagatcatcttaattcagaaatcttcaaatgtttctactaaatgagattaaaaaaaataaaac

SEQ ID NO: 286335 - DNA, 522 bp, Homo sapiens
caggacggaagttccagatgtcttcacagaatttccaaatgctatttcttcatttgcaatttctgttcctgccatccgcccccatgtagcctctgcccagtcttcaacccccgcctttggagtccgtggaggaaaagagcagaaacaggagcccagagaccattccagactcaccaggtatgggcgctgccgacttaatttttacaaaaccaagccaatccgtccctaggtaaatttttgtaagcaaggtgcccactaggtaggaaggctgcatttaatgctaatttactgtaaggtctagggaagtcctttccgcttctctgggcctcagtttcctcatctgccaaatagggaaatggatgagatgattgctaaggtcccttcagttccatgagtctatgaaatgtttattgctattgcttttccttcactatcctcaccttcagagctgccagcacccacctggaatgtggttccttcacttgggccatgaatggcacaggtaaccaagagcttggcctg

SEQ ID NO: 286336 - DNA, 1956 bp, Homo sapiens
aaactttctctgatctcctctctctctgtgtctgctccaaatgtagacagcaattgtctgggtaggaccagcttataaagaagcatggctttgttaaggaagtcgtattcagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttggtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaaaaaaaaaaaaaacatgta

SEQ ID NO: 286337 - DNA, 2707 bp, Homo sapiens
attcctgtgctgcgactgtgccgcgcccagagcagcagcaacagcgaagatgcgaggccattacctgtttgatccctgtcggaaacctggcacgggccaacttttcccgattatcacgccaagaagttgcaaggactagtcgaagactcggaggggccagggcgagggcgcgctcccccgcgcgctgcctcctccctcctccctccggccgcccgagctcccggcctctctcccgcccgcgctcactccctccgcccgcctccctcctctggccccctccgcgcggcacagggcggggggtgccgcgaaactccgacccgagccacttggacttgcacagtgtccgccgggcgcaggggccgaccgcacgcagtcgcgcagttctgcctccgcctgccagtctcgcccgcgatcccggcccggggctgtggcgtcgactccgacccaggcagccagcagcccgcgcgggagccggaccgccgccggaggagctcggacggcatgctgagccccctccttggctgaagcccgagtgcggagaagcccgggcaaacgcaggctaaggagaccaaagcggcgaagtcgcgagacagcggacaagcagcggaggagaaggaggaggaggcgaacccagagaggggcagcaaaagaagcggtggtggtgggcgtcgtggccatggcggcggctatcgccagctcgctcatccgtcagaagaggcaagcccgcgagcgcgagaaatccaacgcctgcaagtgtgtcagcagccccagcaaaggcaagaccagctgcgacaaaaacaagttaaatgtcttttcccgggtcaaactcttcggctccaagaagaggcgcagaagaagaccagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttggtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaaaaaaaaaaaaaacatgta

SEQ ID NO: 286338 - DNA, 2587 bp, Homo sapiens
actgtttcctcccgaagctcctttcgggaaaaggaggggagaaggatttggacgactggggcagtgcggaagcccctacaggtgttagccgcccgagctcccggcctctctcccgcccgcgctcactccctccgcccgcctccctcctctggccccctccgcgcggcacagggcggggggtgccgcgaaactccgacccgagccacttggacttgcacagtgtccgccgggcgcaggggccgaccgcacgcagtcgcgcagttctgcctccgcctgccagtctcgcccgcgatcccggcccggggctgtggcgtcgactccgacccaggcagccagcagcccgcgcgggagccggaccgccgccggaggagctcggacggcatgctgagccccctccttggctgaagcccgagtgcggagaagcccgggcaaacgcaggctaaggagaccaaagcggcgaagtcgcgagacagcggacaagcagcggaggagaaggaggaggaggcgaacccagagaggggcagcaaaagaagcggtggtggtgggcgtcgtggccatggcggcggctatcgccagctcgctcatccgtcagaagaggcaagcccgcgagcgcgagaaatccaacgcctgcaagtgtgtcagcagccccagcaaaggcaagaccagctgcgacaaaaacaagttaaatgtcttttcccgggtcaaactcttcggctccaagaagaggcgcagaagaagaccagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttggtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaaaaaaaaaaaaaacatgta

SEQ ID NO: 286339 - DNA, 2378 bp, Homo sapiens
cgcgtgcccacaccttgccgtttatatagaatgcgccgcggtgttgattcgtggctctctaggaccggagagttctttggaaggagagcgcgagcgagggagcgggcgagctccgagggggtgtgggtgtagggagagagagaaagagagcaggcagcggcggcggcggcagcggtggggaaaagcggattccgccccgaaccacaccgaggggagctcgtggtcgagacttgccgccctaagcactctcccaagtccgacccgctcggcgaggacttccgtcttctgagcgaaccttgtcaagcaagctgggatctatgagtggaaaggtgaccaagcccaaagaggagaaagatgcttctaaggttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttggtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaaaaaaaaaaaaaacatgta

SEQ ID NO: 286340 - DNA, 2488 bp, Homo sapiens
cgcgtgcccacaccttgccgtttatatagaatgcgccgcggtgttgattcgtggctctctaggaccggagagttctttggaaggagagcgcgagcgagggagcgggcgagctccgagggggtgtgggtgtagggagagagagaaagagagcaggcagcggcggcggcggcagcggtggggaaaagcggattccgccccgaaccacaccgaggggagctcgtggtcgagacttgccgccctaagcactctcccaagtccgacccgctcggcgaggacttccgtcttctgagcgaaccttgtcaagcaagctgggatctatgagtggaaaggtgaccaagcccaaagaggagaaagatgcttctaagggagtttctctgcacaagctctctgtttgcctgctgtcgtccacataagatgtgacttgctcctgcttgccttcctccatgattgtgaggcctccccagccacgtggaactttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttggtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaaaaaaaaaaaaaacatgta

SEQ ID NO: 286341 - DNA, 2562 bp, Homo sapiens
cgcgtgcccacaccttgccgtttatatagaatgcgccgcggtgttgattcgtggctctctaggaccggagagttctttggaaggagagcgcgagcgagggagcgggcgagctccgagggggtgtgggtgtagggagagagagaaagagagcaggcagcggcggcggcggcagcggtggggaaaagcggattccgccccgaaccacaccgaggggagctcgtggtcgagacttgccgccctaagcactctcccaagtccgacccgctcggcgaggacttccgtcttctgagcgaaccttgtcaagcaagctgggatctatgagtggaaaggtgaccaagcccaaagaggagaaagatgcttctaagggagtttctctgcacaagctctctgtttgcctgctgtcgtccacataagatgtgacttgctcctgcttgccttcctccatgattgtgaggcctccccagccacgtggaactaggtgtcatgaggacaagcatgaaaaaagtagggatgcatcatttgagttcttcaggaggaagctactacctaattctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttggtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaaaaaaaaaaaaaacatgta

SEQ ID NO: 286342 - DNA, 2515 bp, Homo sapiens
cgcgtgcccacaccttgccgtttatatagaatgcgccgcggtgttgattcgtggctctctaggaccggagagttctttggaaggagagcgcgagcgagggagcgggcgagctccgagggggtgtgggtgtagggagagagagaaagagagcaggcagcggcggcggcggcagcggtggggaaaagcggattccgccccgaaccacaccgaggggagctcgtggtcgagacttgccgccctaagcactctcccaagtccgacccgctcggcgaggacttccgtcttctgagcgaaccttgtcaagcaagctgggatctatgagtggaaaggtgaccaagcccaaagaggagaaagatgcttctaagggagtttctctgcacaagctctctgtttgcctgctgtcgtccacataagatgtgacttgctcctgcttgccttcctccatgattgtgaggcctccccagccacgtggaactgtgagtcctattaaacctctttcttttttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttggtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaaaaaaaaaaaaaacatgta

SEQ ID NO: 286343 - DNA, 2198 bp, Homo sapiens
  misc_feature (2)..(2): n is a, c, g, or t
anacctccttccccccccccgccacccgacacctcctaatcctaaactccttatccaccccaaccctccgggaaggcaggagtttgcacccttcgacacgccgcgtgcaaagcagggggatctatcctccctggccacatgggcctttggctgatggaaaggctgggctttgaggaagctgcatagttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttggtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaaaaaaaaaaaaaacatgta

SEQ ID NO: 286344 - DNA, 1491 bp, Homo sapiens
ttaactggatggcactacacttcacacgtgggggagcaggtcgaactcaaaccatgcgaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttggtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaaaaaaaaaaaaaacatgta

SEQ ID NO: 286345 - DNA, 1016 bp, Homo sapiens
  misc_feature (489)..(490): n is a, c, g, or t
  misc_feature (506)..(506): n is a, c, g, or t
  misc_feature (509)..(509): n is a, c, g, or t
cgcgtgcccacaccttgccgtttatatagaatgcgccgcggtgttgattcgtggctctctaggaccggagagttctttggaaggagagcgcgagcgagggagcgggcgagctccgagggggtgtgggtgtagggagagagagaaagagagcaggcagcggcggcggcggcagcggtggggaaaagcggattccgccccgaaccacaccgaggggagctcgtggtcgagacttgccgccctaagcactctcccaagtccgacccgctcggcgaggacttccgtcttctgagcgaaccttgtcaagcaagctgggatctatgagtggaaaggtgaccaagcccaaagaggagaaagatgcttctaaggagcctcagcttaagggtatagttaccaagctatacagccgacaaggctaccacttgcagctgcaggcggatggaaccattgatggcaccaaagatgaggacagcacttacactctgtttaacnnctcatccctgtggcgntcntgccaggaaagatccggggtttgggggacctttaatttccacctaaaacggggacaacggcttttccccgaaaagaaccacccgagaaaacggcccttggtttaaaccttttctgggggggaccccaaaaaaggttggggccaaaaaacccagaaaggtttgcggacaacggcgcggacaaatttcaccgcttgtgtgggttaaaccaagaaccccaattccaggggccaaaaaccctttttagtcttccgaagccgaaccccccgttgggagaacgagttgggcccgaagagcagttcttccgaagactaaggccaacaattcccaaggttgtgtttatactgggcgaaagaaattttgccattttaacataggtttggaaaccaatttcaattttcccaattcctgaaaatggacaatcatttaccccggttcccaagcctaagcccaaggtccacaaggggccccggaaggggggtcgggggtatattccttgcggggtcctgg

SEQ ID NO: 286346 - DNA, 826 bp, Homo sapiens
tgccagtgcgcgggcagcccacccaggcaactcccagcgagcggcccgcgcggagcccagggaggccggcagtgaagccggggagtcccggccgctcctctcggccgccccgggggttgcgagcgtggctctccgcaggcgggcagaagctgagggcgcggggcgcggaggaagcgccgcgccgctttgtctcttcacttcttgagcgcggcgagcggctcctcccgcggccggccgctcgggatcgcggcggcggcggcggcgacggcggctcctccttcacccctttcctttcctccccactctctcgtaggcagcggcggcggcggcagcggtggggaaaagcggattccgccccgaaccacaccgaggggagctcgtggtcgagacttgccgccctaagcactctcccaagtccgacccgctcggcgaggacttccgtcttctgagcgaaccttgtcaagcaagctgggatctatgagtggaaaggtgaccaagcccaaagaggagaaagatgcttctaagggtaagcccgcccgccgagtccgcctgctttcctttccttcgtttccctcgccccctcgcgtgcgcgccgccctccggcggctccttgcctccttcccggagcctaagctgcccatgacctctgcgaccccgggagaaaagggggggcagaggtcgctagggggtggatctaggtttgcaccactttccctccttcctcgcggaattgtcgaccctcgagtgcctccagcctcctccacttcccctctggacgcacggtggtggcgctgcgggcagacgaagctgctgcagcctggagcgc

SEQ ID NO: 286347 - DNA, 2729 bp, Homo sapiens
aggcgggcgtcgcccccaccccgcgctccaggtaccggcggcctcagctgccggcggtggctggctgagctccccagcggcccgcgggccggggcgggggcgggccgggggcgttcccgcgggccaccgcccgtgatgtcacaatcgcggcgggccgcggcgctccggggtcggcggtgggcggcgggccgcgagccggcgatcgaagcgggcagctcgcgcctgagtcatggacttcccctggcccctcctctaccactcccactccctcgccggacccccccgccggggctagcgtctgccgcggctccgagggggtggggctgctgggaatggctgtgcccccttcggcccctcagccgcgcgcgtcctttcacctgaggaggcacacgccttgcccgcagtgctcatggggcatggaggagaaggcggcggccagcgccagctgccgggagccgccgggccccccgagggccgccgccgtcgcgtacttcggcatttccgtggacccggacgacatccttcccggggccctgcgcctcatccaggagctgcggccgcattggaaacccgagcaagttcggaccaagcgcttcacggatggcatcaccaacaagctggtggcctgctatgtggaggaggacatgcaggactgcgtgctggtccgggtgtatggggagcggacggagctgctggtggaccgggagaatgaggtcagaaacttccagctgctgcgagcacacagctgtgcccccaaactctactgcaccttccagaatgggctgtgctatgagtacatgcagggtgtggccctggagcctgagcacatccgtgagccccggcttttcaggttaatcgccttagaaatggcaaagattcatactatccacgccaacggcagcctgcccaagcccatcctctggcacaagatgcacaattatttcacgcttgtgaagaacgagatcaaccccagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctgggtcctagctgtgtgtcttccacaatgactgcatccctccagtgctgtagagtcggaaacaggcatggggagattgccaggctgaccctctctggtctgtttccaggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccccaccaggcttgggaggaagtgcctgcagccaggtcctgaaccataaccacccctgggaaacacatcattcccagcctcaggccctgctggaattggggctgccttatatgtgtgtttaccccttcctggcctggggaaggaggcggggagggctcctttctacctccagtgccctgagcctccagtccgtctccccctgcatgccccatgtgggaggtgctgagctccaaaccagcatcacaccaactctgacacatggatgtacctatcttggtgatgggtgggggccaagaattgagcatgacatcttccccagcagccacctcctctgagatccctcaccttctccaaaccagatccaatcaaacctcagcccgaggaaacatgctccccaacgtgctctcctgtgcttctgttttgtccccctgctggggggacaggagagggagtggtgaggccctgggcctccagagcctggctctgctttgtgctgtggcttagccggaggggacgtggccaagggtgaggtggccaaaaccagaaccagcagtctcctgccttgttccctccctggccctcaggccctccttccagggatgtctctccagctctactttatgtcctgaagctgacccgaggtcttcctatctggaatgactagagggagccaagaggatggggtgggggccagggccccccagggcctatcgtgggagagcctgggcaggatcccatcagaaaggtgctgactaaactggttgcccggacactcaacagcctccacctccctttctaccctcacagctcctggggccttcctggctctggcccagaaagtgattcatttgtaaattatcatggttttctttctgcattaaaatgctcatttccggaaaaaaaag

SEQ ID NO: 286348 - DNA, 2623 bp, Homo sapiens
aggcgggcgtcgcccccaccccgcgctccaggtaccggcggcctcagctgccggcggtggctggctgagctccccagcggcccgcgggccggggcgggggcgggccgggggcgttcccgcgggccaccgcccgtgatgtcacaatcgcggcgggccgcggcgctccggggtcggcggtgggcggcgggccgcgagccggcgatcgaagcgggcagctcgcgcctgagtcatggacttcccctggcccctcctctaccactcccactccctcgccggacccccccgccggggctagcgtctgccgcggctccgagggggtggggctgctgggaatggctgtgcccccttcggcccctcagccgcgcgcgtcctttcacctgaggaggcacacgccttgcccgcagtgctcatggggcatggaggagaaggcggcggccagcgccagctgccgggagccgccgggccccccgagggccgccgccgtcgcgtacttcggcatttccgtggacccggacgacatccttcccggggccctgcgcctcatccaggagctgcggccgcattggaaacccgagcaagttcggaccaagcgcttcacggatggcatcaccaacaagctggtggcctgctatgtggaggaggacatgcaggactgcgtgctggtccgggtgtatggggagcggacggagctgctggtggaccgggagaatgaggtcagaaacttccagctgctgcgagcacacagctgtgcccccaaactctactgcaccttccagaatgggctgtgctatgagtacatgcagggtgtggccctggagcctgagcacatccgtgagccccggcttttcaggttaatcgccttagaaatggcaaagattcatactatccacgccaacggcagcctgcccaagcccatcctctggcacaagatgcacaattatttcacgcttgtgaagaacgagatcaaccccagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccccaccaggcttgggaggaagtgcctgcagccaggtcctgaaccataaccacccctgggaaacacatcattcccagcctcaggccctgctggaattggggctgccttatatgtgtgtttaccccttcctggcctggggaaggaggcggggagggctcctttctacctccagtgccctgagcctccagtccgtctccccctgcatgccccatgtgggaggtgctgagctccaaaccagcatcacaccaactctgacacatggatgtacctatcttggtgatgggtgggggccaagaattgagcatgacatcttccccagcagccacctcctctgagatccctcaccttctccaaaccagatccaatcaaacctcagcccgaggaaacatgctccccaacgtgctctcctgtgcttctgttttgtccccctgctggggggacaggagagggagtggtgaggccctgggcctccagagcctggctctgctttgtgctgtggcttagccggaggggacgtggccaagggtgaggtggccaaaaccagaaccagcagtctcctgccttgttccctccctggccctcaggccctccttccagggatgtctctccagctctactttatgtcctgaagctgacccgaggtcttcctatctggaatgactagagggagccaagaggatggggtgggggccagggccccccagggcctatcgtgggagagcctgggcaggatcccatcagaaaggtgctgactaaactggttgcccggacactcaacagcctccacctccctttctaccctcacagctcctggggccttcctggctctggcccagaaagtgattcatttgtaaattatcatggttttctttctgcattaaaatgctcatttccggaaaaaaaag

SEQ ID NO: 286349 - DNA, 2500 bp, Homo sapiens
aggcgggcgtcgcccccaccccgcgctccaggtaccggcggcctcagctgccggcggtggctggctgagctccccagcggcccgcgggccggggcgggggcgggccgggggcgttcccgcgggccaccgcccgtgatgtcacaatcgcggcgggccgcggcgctccggggtcggcggtgggcggcgggccgcgagccggcgatcgaagcgggcagctcgcgcctgagtcatggacttcccctggcccctcctctaccactcccactccctcgccggacccccccgccggggctagcgtctgccgcggctccgagggggtggggctgctgggaatggctgtgcccccttcggcccctcagccgcgcgcgtcctttcacctgaggaggcacacgccttgcccgcagtgctcatggggcatggaggagaaggcggcggccagcgccagctgccgggagccgccgggccccccgagggccgccgccgtcgcgtacttcggcatttccgtggacccggacgacatccttcccggggccctgcgcctcatccaggagctgcggccgcattggaaacccgagcaagttcggaccaagcgcttcacggatggcatcaccaacaagctggtggcctgctatgtggaggaggacatgcaggactgcgtgctggtccgggtgtatggggagcggacggagctgctggtggaccgggagaatgaggtcagaaacttccagctgctgcgagcacacagctgtgcccccaaactctactgcaccttccagaatgggctgtgctatgagtacatgcagggtgtggccctggagcctgagcacatccgtgagccccggcttttcagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccccaccaggcttgggaggaagtgcctgcagccaggtcctgaaccataaccacccctgggaaacacatcattcccagcctcaggccctgctggaattggggctgccttatatgtgtgtttaccccttcctggcctggggaaggaggcggggagggctcctttctacctccagtgccctgagcctccagtccgtctccccctgcatgccccatgtgggaggtgctgagctccaaaccagcatcacaccaactctgacacatggatgtacctatcttggtgatgggtgggggccaagaattgagcatgacatcttccccagcagccacctcctctgagatccctcaccttctccaaaccagatccaatcaaacctcagcccgaggaaacatgctccccaacgtgctctcctgtgcttctgttttgtccccctgctggggggacaggagagggagtggtgaggccctgggcctccagagcctggctctgctttgtgctgtggcttagccggaggggacgtggccaagggtgaggtggccaaaaccagaaccagcagtctcctgccttgttccctccctggccctcaggccctccttccagggatgtctctccagctctactttatgtcctgaagctgacccgaggtcttcctatctggaatgactagagggagccaagaggatggggtgggggccagggccccccagggcctatcgtgggagagcctgggcaggatcccatcagaaaggtgctgactaaactggttgcccggacactcaacagcctccacctccctttctaccctcacagctcctggggccttcctggctctggcccagaaagtgattcatttgtaaattatcatggttttctttctgcattaaaatgctcatttccggaaaaaaaag

SEQ ID NO: 286350 - DNA, 2339 bp, Homo sapiens
  misc_feature (2174)..(2174): n is a, c, g, or t
  misc_feature (2176)..(2176): n is a, c, g, or t
aggcgggcgtcgcccccaccccgcgctccaggtaccggcggcctcagctgccggcggtggctggctgagctccccagcggcccgcgggccggggcgggggcgggccgggggcgttcccgcgggccaccgcccgtgatgtcacaatcgcggcgggccgcggcgctccggggtcggcggtgggcggcgggccgcgagccggcgatcgaagcgggcagctcgcgcctgagtcatggacttcccctggcccctcctctaccactcccactccctcgccggacccccccgccggggctagcgtctgccgcggctccgagggggtggggctgctgggaatggctgtgcccccttcggcccctcagccgcgcgcgtcctttcacctgaggaggcacacgccttgcccgcagtgctcatggggcatggaggagaaggcggcggccagcgccagctgccgggagccgccgggccccccgagggccgccgccgtcgcgtacttcggcatttccgtggacccggacgacatccttcccggggccctgcgcctcatccaggagctgcggccgcattggaaacccgagcaagttcggaccaagcgcttcacggatggcatcaccaacaagctggtggcctgctatgtggaggaggacatgcaggactgcgtgctggtccgggtgtatggggagcggacggagctgctggtggaccgggagaatgaggtcagaaacttccagctgctgcgagcacacagctgtgcccccaaactctactgcaccttccagaatgggctgtgctatgagtacatgcagggtgtggccctggagcctgagcacatccgtgagccccggcttttcaggttaatcgccttagaaatggcaaagattcatactatccacgccaacggcagcctgcccaagcccatcctctggcacaagatgcacaattatttcacgcttgtgaagaacgagatcaaccccagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccccaccaggcttgggaggaagtgcctgcagccaggtcctgaaccataaccacccctgggaaacacatcattcccagcctcaggccctgctggaattggggctgccttatatgtgtgtttaccccttcctggcctggggaaggaggcggggagggctcctttctacctccagtgccctgagcctccagtccgtctccccctgcatgccccatgtgggaggtgctgagctccaaaccagcatcacaccaactctgacacatggatgtacctatcttggtgatgggtgggggccaagaattgagcatgacatcttccccagcagccacctcctctgagatccctcaccttctccaaaccagatccaatcaaacctcagcccgaggaaacatgctccccaacgtgctctcctgtgcttctgttttgtccccctgctggggggacaggagagggagtggncntattcctgtgccccggccctgtcctcactatcagtcagttcagtatttgcttttcacgtgagtggcgggcttttttgtagcaatcagaacttttaaaacaaggcatggagtttgccttgggagatttcccaggaaggaaggaagatttaaaagcggagcctgg

SEQ ID NO: 286351 - DNA, 2311 bp, Homo sapiens
aggcgggcgtcgcccccaccccgcgctccaggtaccggcggcctcagctgccggcggtggctggctgagctccccagcggcccgcgggccggggcgggggcgggccgggggcgttcccgcgggccaccgcccgtgatgtcacaatcgcggcgggccgcggcgctccggggtcggcggtgggcggcgggccgcgagccggcgatcgaagcgggcagctcgcgcctgagtcatggacttcccctggcccctcctctaccactcccactccctcgccggacccccccgccggggctagcgtctgccgcggctccgagggggtggggctgctgggaatggctgtgcccccttcggcccctcagccgcgcgcgtcctttcacctgaggaggcacacgccttgcccgcagtgctcatggggcatggaggagaaggcggcggccagcgccagctgccgggagccgccgggccccccgagggccgccgccgtcgcgtacttcggcatttccgtggacccggacgacatccttcccggggccctgcgcctcatccaggagctgcggccgcattggaaacccgagcaagttcggaccaagcgcttcacggatggcatcaccaacaagctggtggcctgctatgtggaggaggacatgcaggactgcgtgctggtccgggtgtatggggagcggacggagctgctggtggaccgggagaatgaggtcagaaacttccagctgctgcgagcacacagctgtgcccccaaactctactgcaccttccagaatgggctgtgctatgagtacatgcagggtgtggccctggagcctgagcacatccgtgagccccggcttttcaggttaatcgccttagaaatggcaaagattcatactatccacgccaacggcagcctgcccaagcccatcctctggcacaagatgcacaattatttcacgcttgtgaagaacgagatcaaccccagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccccaccaggcttgggaggaagtgcctgcagccaggtcctgaaccataaccacccctgggaaacacatcattcccagcctcaggccctgctggaattggggctgccttatatgtgtgtttaccccttcctggcctggggaaggaggcggggagggctcctttctacctccagtgccctgagcctccagtccgtctccccctgcatgccccatgtgggaggtgctgagctccaaaccagcatcacaccaactctgacacatggatgtacctatcttggtgatgggtgggggccaagaattgagcatgacatcttccccagcagccacctcctctgagatccctcaccttctccaaaccagatccaatcaaacctcagcccgaggaaacatgctccccaacgtgctctcctgtgcttctgttttgtccccctgctggggggacaggagagggagtggaggctcttctcttggcaatggaggttccgaacttgtgaggattcacccctttgattcctctgacccgcatcgaatggccactttttctttaatcttaaggaccccctttgaaagtgcgcccccgcggggcccgggaga

SEQ ID NO: 286352 - DNA, 1999 bp, Homo sapiens
ctggaaagggagcagccaggctaaggtcttaattcattctcctctcttctgctgagaccttccttctgcaggacctgtgctcctaagggacttgcaatcatcccatccttggccctctggcaagtgccctggtgggcctggagggtccctatctggccaggaggaaatgagtggggaaggcaatgtcccagcactgatgctctactcttcctgttccctgctgtaggttaatcgccttagaaatggcaaagattcatactatccacgccaacggcagcctgcccaagcccatcctctggcacaagatgcacaattatttcacgcttgtgaagaacgagatcaaccccagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccccaccaggcttgggaggaagtgcctgcagccaggtcctgaaccataaccacccctgggaaacacatcattcccagcctcaggccctgctggaattggggctgccttatatgtgtgtttaccccttcctggcctggggaaggaggcggggagggctcctttctacctccagtgccctgagcctccagtccgtctccccctgcatgccccatgtgggaggtgctgagctccaaaccagcatcacaccaactctgacacatggatgtacctatcttggtgatgggtgggggccaagaattgagcatgacatcttccccagcagccacctcctctgagatccctcaccttctccaaaccagatccaatcaaacctcagcccgaggaaacatgctccccaacgtgctctcctgtgcttctgttttgtccccctgctggggggacaggagagggagtggtgaggccctgggcctccagagcctggctctgctttgtgctgtggcttagccggaggggacgtggccaagggtgaggtggccaaaaccagaaccagcagtctcctgccttgttccctccctggccctcaggccctccttccagggatgtctctccagctctactttatgtcctgaagctgacccgaggtcttcctatctggaatgactagagggagccaagaggatggggtgggggccagggccccccagggcctatcgtgggagagcctgggcaggatcccatcagaaaggtgctgactaaactggttgcccggacactcaacagcctccacctccctttctaccctcacagctcctggggccttcctggctctggcccagaaagtgattcatttgtaaattatcatggttttctttctgcattaaaatgctcatttccggaaaaaaaag

SEQ ID NO: 286353 - DNA, 1892 bp, Homo sapiens
agcagacggttggggggtgggacagcggaagggaagactggaagaggactgggagggcccagctgggacacagggcctcgggcgatggggtctttatcaaggccctccttctctgaccggttaatcgccttagaaatggcaaagattcatactatccacgccaacggcagcctgcccaagcccatcctctggcacaagatgcacaattatttcacgcttgtgaagaacgagatcaaccccagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccccaccaggcttgggaggaagtgcctgcagccaggtcctgaaccataaccacccctgggaaacacatcattcccagcctcaggccctgctggaattggggctgccttatatgtgtgtttaccccttcctggcctggggaaggaggcggggagggctcctttctacctccagtgccctgagcctccagtccgtctccccctgcatgccccatgtgggaggtgctgagctccaaaccagcatcacaccaactctgacacatggatgtacctatcttggtgatgggtgggggccaagaattgagcatgacatcttccccagcagccacctcctctgagatccctcaccttctccaaaccagatccaatcaaacctcagcccgaggaaacatgctccccaacgtgctctcctgtgcttctgttttgtccccctgctggggggacaggagagggagtggtgaggccctgggcctccagagcctggctctgctttgtgctgtggcttagccggaggggacgtggccaagggtgaggtggccaaaaccagaaccagcagtctcctgccttgttccctccctggccctcaggccctccttccagggatgtctctccagctctactttatgtcctgaagctgacccgaggtcttcctatctggaatgactagagggagccaagaggatggggtgggggccagggccccccagggcctatcgtgggagagcctgggcaggatcccatcagaaaggtgctgactaaactggttgcccggacactcaacagcctccacctccctttctaccctcacagctcctggggccttcctggctctggcccagaaagtgattcatttgtaaattatcatggttttctttctgcattaaaatgctcatttccggaaaaaaaag

SEQ ID NO: 286354 - DNA, 1770 bp, Homo sapiens
agcagggttttggttggttggttagctggcttcacggagctgttcttccggctggcacttggacaagcaaaagttagaccttgatttaggtcttaagttaatttgtaggagggaagggggaaaggaaataaaaaattcccactttgaaaagtctgtgccaagggccagtctcagtggctcatgcctataatcccagcagtttgggaggccaaggcatgtggattgcttaagcccaggaattcaagaccagcccaggcaatgtggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccccaccaggcttgggaggaagtgcctgcagccaggtcctgaaccataaccacccctgggaaacacatcattcccagcctcaggccctgctggaattggggctgccttatatgtgtgtttaccccttcctggcctggggaaggaggcggggagggctcctttctacctccagtgccctgagcctccagtccgtctccccctgcatgccccatgtgggaggtgctgagctccaaaccagcatcacaccaactctgacacatggatgtacctatcttggtgatgggtgggggccaagaattgagcatgacatcttccccagcagccacctcctctgagatccctcaccttctccaaaccagatccaatcaaacctcagcccgaggaaacatgctccccaacgtgctctcctgtgcttctgttttgtccccctgctggggggacaggagagggagtggtgaggccctgggcctccagagcctggctctgctttgtgctgtggcttagccggaggggacgtggccaagggtgaggtggccaaaaccagaaccagcagtctcctgccttgttccctccctggccctcaggccctccttccagggatgtctctccagctctactttatgtcctgaagctgacccgaggtcttcctatctggaatgactagagggagccaagaggatggggtgggggccagggccccccagggcctatcgtgggagagcctgggcaggatcccatcagaaaggtgctgactaaactggttgcccggacactcaacagcctccacctccctttctaccctcacagctcctggggccttcctggctctggcccagaaagtgattcatttgtaaattatcatggttttctttctgcattaaaatgctcatttccggaaaaaaaag

SEQ ID NO: 286355 - DNA, 1579 bp, Homo sapiens
agcagggttttggttggttggttagctggcttcacggagctgttcttccggctggcacttggacaagcaaaagtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccccaccaggcttgggaggaagtgcctgcagccaggtcctgaaccataaccacccctgggaaacacatcattcccagcctcaggccctgctggaattggggctgccttatatgtgtgtttaccccttcctggcctggggaaggaggcggggagggctcctttctacctccagtgccctgagcctccagtccgtctccccctgcatgccccatgtgggaggtgctgagctccaaaccagcatcacaccaactctgacacatggatgtacctatcttggtgatgggtgggggccaagaattgagcatgacatcttccccagcagccacctcctctgagatccctcaccttctccaaaccagatccaatcaaacctcagcccgaggaaacatgctccccaacgtgctctcctgtgcttctgttttgtccccctgctggggggacaggagagggagtggtgaggccctgggcctccagagcctggctctgctttgtgctgtggcttagccggaggggacgtggccaagggtgaggtggccaaaaccagaaccagcagtctcctgccttgttccctccctggccctcaggccctccttccagggatgtctctccagctctactttatgtcctgaagctgacccgaggtcttcctatctggaatgactagagggagccaagaggatggggtgggggccagggccccccagggcctatcgtgggagagcctgggcaggatcccatcagaaaggtgctgactaaactggttgcccggacactcaacagcctccacctccctttctaccctcacagctcctggggccttcctggctctggcccagaaagtgattcatttgtaaattatcatggttttctttctgcattaaaatgctcatttccggaaaaaaaag

SEQ ID NO: 286356 - DNA, 1552 bp, Homo sapiens
aggcgggcgtcgcccccaccccgcgctccaggtaccggcggcctcagctgccggcggtggctggctgagctccccagcggcccgcgggccggggcgggggcgggccgggggcgttcccgcgggccaccgcccgtgatgtcacaatcgcggcgggccgcggcgctccggggtcggcggtgggcggcgggccgcgagccggcgatcgaagcgggcagctcgcgcctgagtcatggacttcccctggcccctcctctaccactcccactccctcgccggacccccccgccggggctagcgtctgccgcggctccgagggggtggggctgctgggaatggctgtgcccccttcggcccctcagccgcgcgcgtcctttcacctgaggaggcacacgccttgcccgcagtgctcatggggcatggaggagaaggcggcggccagcgccagctgccgggagccgccgggccccccgagggccgccgccgtcgcgtacttcggcatttccgtggacccggacgacatccttcccggggccctgcgcctcatccaggagctgcggccgcattggaaacccgagcaagttcggaccaagcgcttcacggatggcatcaccaacaagctggtggcctgctatgtggaggaggacatgcaggactgcgtgctggtccgggtgtatggggagcggacggagctgctggtggaccgggagaatgaggtcagaaacttccagctgctgcgagcacacagctgtgcccccaaactctactgcaccttccagaatgggctgtgctatgagtacatgcagggtgtggccctggagcctgagcacatccgtgagccccggcttttcaggttaatcgccttagaaatggcaaagattcatactatccacgccaacggcagcctgcccaagcccatcctctggcacaagatgcacaattatttcacgcttgtgaagaacgagatcaaccccagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaaccagtactccaccatcgactttgatttcctcaggtacgcagtgatccgattcaaccagtacttcaagctcctggggccttcctggctctggcccagaaagtgattcatttgtaaattatcatggttttctttctgcattaaaatgctcatttccggaaaaaaaag

SEQ ID NO: 286357 - DNA, 1830 bp, Homo sapiens
ggtgattcctaggggtaggcaggtgttctataaaggcatagtatgcacaatggaaccatttgtgtagaggaggcaaggcaggtttttccagcttgagggcttaattagatggaaccgaggaggcaactcacatggacggagctggacactggggctggagagctgtccccagactagcacagtaaagtgttcacatgatggggccaggccctgtggctcaggatagagaggcatgcccaggccaactggacagccattctccagccccatcaggccaattgtgttccttctggaaccccaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctgggtcctagctgtgtgtcttccacaatgactgcatccctccagtgctgtagagtcggaaacaggcatggggagattgccaggctgaccctctctggtctgtttccaggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccccaccaggcttgggaggaagtgcctgcagccaggtcctgaaccataaccacccctgggaaacacatcattcccagcctcaggccctgctggaattggggctgccttatatgtgtgtttaccccttcctggcctggggaaggaggcggggagggctcctttctacctccagtgccctgagcctccagtccgtctccccctgcatgccccatgtgggaggtgctgagctccaaaccagcatcacaccaactctgacacatggatgtacctatcttggtgatgggtgggggccaagaattgagcatgacatcttccccagcagccacctcctctgagatccctcaccttctccaaaccagatccaatcaaacctcagcccgaggaaacatgctccccaacgtgctctcctgtgcttctgttttgtccccctgctggggggacaggagagggagtggtgaggccctgggcctccagagcctggctctgctttgtgctgtggcttagccggaggggacgtggccaagggtgaggtggccaaaaccagaaccagcagtctcctgccttgttccctccctggccctcaggccctccttccagggatgtctctccagctctactttatgtcctgaagctgacccgaggtcttcctatctggaatgactagagggagccaagaggatggggtgggggccagggccccccagggcctatcgtgggagagcctgggcaggatcccatcagaaaggtgctgactaaactggttgcccggacactcaacagcctccacctccctttctaccctcacagctcctggggccttcctggctctggcccagaaagtgattcatttgtaaattatcatggttttctttctgcattaaaatgctcatttccggaaaaaaaag

SEQ ID NO: 286358 - DNA, 838 bp, Homo sapiens
caccgccagggctccccatgcatggggtgaactccctgcccggcgccaggccatgcagcctcccctgagactcaggtcccaggaccaacccggtcaggaaggccctggggacaccgaggccagccagacagagcctggcagctcggctgtgactctgcagtgagcagccctccctgtcccagaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggaaatgaggaccaccatgagttcatctggaagttccactccatggcctccaggtaataaccttggagagagctcagccagggtctggtggctgcgggcacgggcatctcagctccactggttcctccattcagcttaaccagcgcctcccaagcagctgcctatagctggctctataactgagcctggggaagatagaggaaagtcacgtccctgccttcaagggtctcgcagacaggtggggaggcagatggtgaactgtgggtacctagaacagcagaagttcactcaagctacagaaatactagaggagggtagctcatgcctgcaatcccagtactttgggaggccaaggcaggagtattgctggaggccgggagttcgagaccagcctggccaatgtagtaacacccccgtctctacaaaaaatacaaaaataaaaaaattagttggga

SEQ ID NO: 286359 - DNA, 1729 bp, Homo sapiens
cgcgcgggaacatggggctgtacgctgcggtggcaggcgtgctggccggcgtggagagccgccagggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaagggtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccagcctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcaacctctgcctcctgggttcaagcgattctcctgcttcagccttctgagtagctgggattatgaaggggtggcctgcccctccacatctgtgggatatctcatcagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggacccccgccaggctcccatgtcatggatgcctgtgccaccccaggcaataaagaccagtcacttggctgctcttctgaagaaccaagggaagatctttgcctttgacctggatgccaggcggctggcatccatggccacgctgctggcctgggctggcgtctcctgctgtgagctggctgaggaggacttcctggcggtctcccccttagatccgcgctatcgtgaggtccactatgtcctgctggatccttcctgcagtggctcggggtatgccgagcagacagctggaggagcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtacaagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacctcagcctcacaggccaaagcatcagcaccagaacgcacacccagcccagccccaaagagaaagaagagagcaaaaagctgcagccggtgcttgcacaccgccttgcacatagcagaggctccgggctcactccttcctggtgggaaaggaagatgcctgtcctctccgtggaggaccctgggccctcaccgcaggcagcagtttgcgttttgaaaggttattgggtcccttcctcgggctgtgttcttgctggtgagcaaaagtgttgcctgcagaaataaaatgcagaacgtactctac

SEQ ID NO: 286360 - DNA, 1837 bp, Homo sapiens
cgcgcgggaacatggggctgtacgctgcggtggcaggcgtgctggccggcgtggagagccgccagggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaagggtaggggcggggcggggaagtgaaccccgacggtcagcgctttgtcatctggtttcagccccgctgccgtgcacggcgggactggagcaagtcgctcacctgaaatgagtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccagcctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcaacctctgcctcctgggttcaagcgattctcctgcttcagccttctgagtagctgggattatgaaggggtggcctgcccctccacatctgtgggatatctcatcagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggacccccgccaggctcccatgtcatggatgcctgtgccaccccaggcaataaagaccagtcacttggctgctcttctgaagaaccaagggaagatctttgcctttgacctggatgccaggcggctggcatccatggccacgctgctggcctgggctggcgtctcctgctgtgagctggctgaggaggacttcctggcggtctcccccttagatccgcgctatcgtgaggtccactatgtcctgctggatccttcctgcagtggctcggggtatgccgagcagacagctggaggagcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtacaagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacctcagcctcacaggccaaagcatcagcaccagaacgcacacccagcccagccccaaagagaaagaagagagcaaaaagctgcagccggtgcttgcacaccgccttgcacatagcagaggctccgggctcactccttcctggtgggaaaggaagatgcctgtcctctccgtggaggaccctgggccctcaccgcaggcagcagtttgcgttttgaaaggttattgggtcccttcctcgggctgtgttcttgctggtgagcaaaagtgttgcctgcagaaataaaatgcagaacgtactctac

SEQ ID NO: 286361 - DNA, 901 bp, Homo sapiens
cgcgcgggaacatggggctgtacgctgcggtggcaggcgtgctggccggcgtggagagccgccagggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaagggtaggggcggggcggggaagtgaaccccgacggtcagcgctttgtcatctggtttcagccccgctgccgtgcacggcgggactggagcaagtcgctcacctgaaatgagtatgagcagaccttccctgggttacgaattgagatgggatgaaaatgctttaacttcgagtgttttgaaggattaaataaccgaagtacaaagtagtagtagcggagacagtaaggaagtcgggcgtggcggcgcgcacctgtggtcccagctactcggaaggctgaggggggaggatcacttgagcccaggagttcgaagctgcagtgagctgtgatgtggccactgcacttcagcctgggcgacagatctagaccccattctaaaaaaaaacaaaaaccccaaacccacacccacgaaagggtaatgttggcaagaagttgggtgcagaggtctactggtgaacatctgtggggaaagggtctaaggctgggaagcgagacgccaggttccgatcctgttgtgtagttaatttctggtgtggtcttgagtaaggtaccccacctttatctgtaaccatctagtcaggtgatctctttagccattccagtgcccgggctctattagagttagttctaaggcattcatacttcttgcttagggcgtttctgtctttgatccctcatc

SEQ ID NO: 286362 - DNA, 2457 bp, Homo sapiens
cgcgcgggaacatggggctgtacgctgcggtggcaggcgtgctggccggcgtggagagccgccagggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaagggtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccagcctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcaacctctgcctcctgggttcaagcgattctcctgcttcagccttctgagtagctgggattatgaaggggtggcctgcccctccacatctgtgggatatctcatcagcctcgatgacttacgagccctcaaggggaagcattttctcctggaccccttgatgccggagctgctggtgtttcccgcccagacagatctgcatgaacacccactgtaccgggccggacacctcattctgcaggacagggtaggcaagaggaatagaaaagggaagaatgtgtaggcacgggaagggcctagcctggggtctctgtttacccggcccctgtgttctgcctgccaggccagctgtctcccagccatgctgctggacccccgccaggctcccatgtcatggatgcctgtgccaccccaggcaataaagaccagtcacttggctgctcttctgaagaaccaagggtgagtgccacaggaggaggaggaggacatggggtttgattttgtgcctttcagtgggtaatgaaggctgaaaggatgactttcgcttaactctttcctgctgcaccaaagtagttcacggtatttgccccaagctaagctttccccactgcaggtgtgagatgtggatcccttagcccttggggcagagaccccaggccagttacctctgaccctgggccctttaaatataggctgtttcaatattgtgtgtcctggcttaacctgcatgttctggttgtctgtgtcagctgtgacaggcccttagctgctccatgcatgctcagctcacccctgctctgccctctgccctaggaagatctttgcctttgacctggatgccaggcggctggcatccatggccacgctgctggcctgggctggcgtctcctgctgtgagctggctgaggaggacttcctggcggtctcccccttagatccgcgctatcgtgaggtccactatgtcctgctggatccttcctgcagtggctcggggagatggtgagaaggcgtggctgagggactcagaggtccacagcagcttagacctggagtcatctgttttggtcttagttctgacactttaatgggcttgggaccctggagcaaaagttctcctctgtgaagcgaggatttcaggagcgaggatttcaggactgaggcagcctgtgaagctgtgtaaccgagacacgcttttccttaggtatgccgagcagacagctggaggagcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtacaagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacatttctctagctcagcctcacaggccaaagcatcagcaccagaacgcacacccagcccagccccaaagagaaagaagagagcaaaaagctgcagccggtgcttgcacaccgccttgcacatagcagaggctccgggctcactccttcctggtgggaaaggaagatgcctgtcctctccgtggaggaccctgggccctcaccgcaggcagcagtttgcgttttgaaaggttattgggtcccttcctcgggctgtgttcttgctggtgagcaaaagtgttgcctgcagaaataaaatgcagaacgtactctac

SEQ ID NO: 286363 - DNA, 1192 bp, Homo sapiens
cgcgcgggaacatggggctgtacgctgcggtggcaggcgtgctggccggcgtggagagccgccagggctctatcaaggggctggtgtactccagcaacttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggacccccgccaggctcccatgtcatggatgcctgtgccaccccaggcaataaagaccagtcacttggctgctcttctgaagaaccaagggaagatctttgcctttgacctggatgccaggcggctggcatccatggccacgctgctggcctgggctggcgtctcctgctgtgagctggctgaggaggacttcctggcggtctcccccttagatccgcgctatcgtgaggtccactatgtcctgctggatccttcctgcagtggctcggggtatgccgagcagacagctggaggagcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtacaagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacctcagcctcacaggccaaagcatcagcaccagaacgcacacccagcccagccccaaagagaaagaagagagcaaaaagctgcagccggtgcttgcacaccgccttgcacatagcagaggctccgggctcactccttcctggtgggaaaggaagatgcctgtcctctccgtggaggaccctgggccctcaccgcaggcagcagtttgcgttttgaaaggttattgggtcccttcctcgggctgtgttcttgctggtgagcaaaagtgttgcctgcagaaataaaatgcagaacgtactctac

SEQ ID NO: 286364 - DNA, 1864 bp, Homo sapiens
aggcgtccagctgcacttcccacttctgactctgtgcctgctgttccctgctgggaagaagaaaagccagtgatgctggcttgaggccatagtgggaggcccagtggatcctgagaagctagcccgggcagtgagtgtggatggcttggcaggtgagcctgctggagctggaggactggcttcagtgtcccatctgcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgaaaaaccggacccgaatcgtcaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggaaatgaggaccaccatgagttcatctggaagttccactccatggcctccagcttaaccagcgcctcccaagcagctgcctatagctggctctataactgagcctggggaagatctttgcctttgacctggatgccaggcggctggcatccatggccacgctgctggcctgggctggcgtctcctgctgtgagctggctgaggaggacttcctggcggtctcccccttagatccgcgctatcgtgaggtccactatgtcctgctggatccttcctgcagtggctcggggagatggtgagaaggcgtggctgagggactcagaggtccacagcagcttagacctggagtcatctgttttggtcttagttctgacactttaatgggcttgggaccctggagcaaaagttctcctctgtgaagcgaggatttcaggagcgaggatttcaggactgaggcagcctgtgaagctgtgtaaccgagacacgcttttccttagcggctcgtctactccatgtgctccctctgccaggaggagaatgaagacatggtacaagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacctcagcctcacaggccaaagcatcagcaccagaacgcacacccagcccagccccaaagagaaagaagagagcaaaaagctgcagccggtgcttgcacaccgccttgcacatagcagaggctccgggctcactccttcctggtgggaaaggaagatgcctgtcctctccgtggaggaccctgggccctcaccgcaggcagcagtttgcgttttgaaaggttattgggtcccttcctcgggctgtgttcttgctggtgagcaaaagtgttgcctgcagaaataaaatgcagaacgtactctac

SEQ ID NO: 286365 - DNA, 1762 bp, Homo sapiens
tttattaaattgtggcacgtaagtatcttggatatattggctcattgaatcctcacacctactattttacagagatgccagtggggcttgagattgaatcacttgcccaggctcccactgctggtaaacagtagagggggctcctgacccataagtctggcttgacaacccattccctcaactgcggatcccggattcccttatcaccctgttgatttctccatagctgtggtaacatttgttgcatgaatggaccgttgaaatagggcctggcagggagaaattcaggaaatgatgaatgaatggttcttccctggcagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggacccccgccaggctcccatgtcatggatgcctgtgccaccccaggcaataaagaccagtcacttggctgctcttctgaagaaccaagggtgagtgccacaggaggaggaggaggacatggggtttgattttgtgcctttcagtgggtaatgaaggctgaaaggatgactttcgcttaactctttcctgctgcaccaaagtagttcacggtatttgccccaagctaagctttccccactgcaggtgtgagatgtggatcccttagcccttggggcagagaccccaggccagttacctctgaccctgggccctttaaatataggctgtttcaatattgtgtgtcctggcttaacctgcatgttctggttgtctgtgtcagctgtgacaggcccttagctgctccatgcatgctcagctcacccctgctctgccctctgccctaggaagatctttgcctttgacctggatgccaggcggctggcatccatggccacgctgctggcctgggctggcgtctcctgctgtgagctggctgaggaggacttcctggcggtctcccccttagatccgcgctatcgtgaggtccactatgtcctgctggatccttcctgcagtggctcggggtatgccgagcagacagctggaggagcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtacaagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacctcagcctcacaggccaaagcatcagcaccagaacgcacacccagcccagccccaaagagaaagaagagagcaaaaagctgcagccggtgcttgcacaccgccttgcacatagcagaggctccgggctcactccttcctggtgggaaaggaagatgcctgtcctctccgtggaggaccctgggccctcaccgcaggcagcagtttgcgttttgaaaggttattgggtcccttcctcgggctgtgttcttgctggtgagcaaaagtgttgcctgcagaaataaaatgcagaacgtactctac

SEQ ID NO: 286366 - DNA, 1335 bp, Homo sapiens
cgcgcgggaacatggggctgtacgctgcggtggcaggcgtgctggccggcgtggagagccgccagggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaagggtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccagcctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcaacctctgcctcctgggttcaagcgattctcctgcttcagccttctgagtagctgggattatgaaggggtggcctgcccctccacatctgtgggatatctcatcagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggacccccgccaggctcccatgtcatggatgcctgtgccaccccaggcaataaagaccagtcacttggctgctcttctgaagaaccaagggaagatctttgcctttgacctggatgccaggcggctggcatccatggccacgctgctggcctgggctggcgtctcctgctgtgagctggctgaggaggacttcctggcggtctcccccttagatccgcgctatcgtgaggtccactatgtcctgctggatccttcctgcagtggctcggggtatgccgagcagacagctggaggagcccggggcagggacacctagcccgcggctcgtctactccatgtgctccctctgccaggaggagaatgaagacatggtacaagatgcgctgcagcagaacccgggcgccttcaggcttaagtcccgccctggctgccgggcccaccgaaggcctgagacgtcccgggtgcgagcactggtccggggttcccccagaccagctagggggctattcgggccgactgacgggccaga

SEQ ID NO: 286367 - DNA, 1457 bp, Homo sapiens
cgcgcgggaacatggggctgtacgctgcggtggcaggcgtgctggccggcgtggagagccgccagggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaagggctggatggagtgccctggcgcgatctcggctcaccgcaacctctgcctcctgggttcaagcgattctcctgcttcagccttctgagtagctgggattatgaaggggtggcctgcccctccacatctgtgggatatctcatcagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggacccccgccaggctcccatgtcatggatgcctgtgccaccccaggcaataaagaccagtcacttggctgctcttctgaagaaccaagggaagatctttgcctttgacctggatgccaggcggctggcatccatggccacgctgctggcctgggctggcgtctcctgctgtgagctggctgaggaggacttcctggcggtctcccccttagatccgcgctatcgtgaggtccactatgtcctgctggatccttcctgcagtggctcggggtatgccgagcagacagctggaggagcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtacaagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacctcagcctcacaggccaaagcatcagcaccagaacgcacacccagcccagccccaaagagaaagaagagagcaaaaagctgcagccggtgcttgcacaccgccttgcacatagcagaggctccgggctcactccttcctggtgggaaaggaagatgcctgtcctctccgtggaggaccctgggccctcaccgcaggcagcagtttgcgttttgaaaggttattgggtcccttcctcgggctgtgttcttgctggtgagcaaaagtgttgcctgcagaaataaaatgcagaacgtactctac

SEQ ID NO: 286368 - DNA, 1885 bp, Homo sapiens
cgcgcgggaacatggggctgtacgctgcggtggcaggcgtgctggccggcgtggagagccgccagggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaagggtgctagtgtatgagttgttgggaaagggctttcgagggggtgggggccaatggaaggctctgttgggacggcaccaggcgaggtgttgagttggctcggctcaaggttcttcggggtgtgagctggcatgaggacctgttggaagtgggatccaggcctggtccagcctcccagctgcctcgatttgtgcgtgtgaacactctcaagacctgctccgtttatgtagttatttcaagagacaaggtttctcctatcagggtcgggcttccaggctggatggagtgccctggcgcgatctcggctcaccgcaacctctgcctcctgggttcaagcgattctcctgcttcagccttctgagtagctgggattatgaaggggtggcctgcccctccacatctgtgggatatctcatcagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggacccccgccaggctcccatgtcatggatgcctgtgccaccccaggcaataaagaccagtcacttggctgctcttctgaagaaccaagggaagatctttgcctttgacctggatgccaggcggctggcatccatggccacgctgctggcctgggctggcgtctcctgctgtgagctggctgaggaggacttcctggcggtctcccccttagatccgcgctatcgtgaggtccactatgtcctgctggatccttcctgcagtggctcggggagatggtgagaaggcgtggctgagggactcagaggtccacagcagcttagacctggagtcatctgttttggtcttagttctgacactttaatgggcttgggaccctggagcaaaagttctcctctgtgaagcgaggatttcaggagcgaggatttcaggactgaggcagcctgtgaagctgtgtaaccgagacacgcttttccttagcggctcgtctactccatgtgctccctctgccaggaggagaatgaagacatggtacaagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgagtgagtgggggcatgcttgggaggcgcaggatggtactggcacatctaacatctacatttctctagctcagcctcacaggccaaagcatcagcaccagaacgcacacccagcccagccccaaagagaaagaagagagcaaaaagctgcagccggtgcttgcacaccgccttgcacatagcagaggctccgggctcactccttcctggtgggaaaggaagatgcctgtcctctccgtggaggaccctgggccctcaccgcaggcagcagtttgcgttttgaaaggttattgggtcccttcctcgggctgtgttcttgctggtgagcaaaagtgttgcctgcagaaataaaatgcagaacgtactctac

SEQ ID NO: 286369 - DNA, 1521 bp, Homo sapiens
cgcgcgggaacatggggctgtacgctgcggtggcaggcgtgctggccggcgtggagagccgccagggctctatcaaggggctggtgtactccagcaacttccagaacgtgaagcagctgtacgcgctggtgtgcgaaacgcagcgctactccgccgtgctggatgccgtgatctccagcgccggcctcctcagtgcgaagaagctgcagccgcacctggccaaggcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggacccccgccaggctcccatgtcatggatgcctgtgccaccccaggcaataaagaccagtcacttggctgctcttctgaagaaccaagggaagatctttgcctttgacctggatgccaggcggctggcatccatggccacgctgctggcctgggctggcgtctcctgctgtgagctggctgaggaggacttcctggcggtctcccccttagatccgcgctatcgtgaggtccactatgtcctgctggatccttcctgcagtggctcggggagatggtgagaaggcgtggctgagggactcagaggtccacagcagcttagacctggagtcatctgttttggtcttagttctgacactttaatgggcttgggaccctggagcaaaagttctcctctgtgaagcgaggatttcaggagcgaggatttcaggactgaggcagcctgtgaagctgtgtaaccgagacacgcttttccttaggtatgccgagcagacagctggaggagcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtacaagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacctcagcctcacaggccaaagcatcagcaccagaacgcacacccagcccagccccaaagagaaagaagagagcaaaaagctgcagccggtgcttgcacaccgccttgcacatagcagaggctccgggctcactccttcctggtgggaaaggaagatgcctgtcctctccgtggaggaccctgggccctcaccgcaggcagcagtttgcgttttgaaaggttattgggtcccttcctcgggctgtgttcttgctggtgagcaaaagtgttgcctgcagaaataaaatgcagaacgtactctac

SEQ ID NO: 286370 - DNA, 1411 bp, Homo sapiens
caccgccagggctccccatgcatggggtgaactccctgcccggcgccaggccatgcagcctcccctgagactcaggtcccaggaccaacccggtcaggaaggccctggggacaccgaggccagccagacagagcctggcagctcggctgtgactctgcagtgagcagccctccctgtcccagaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggaaatgaggaccaccatgagttcatctggaagttccactccatggcctccagcttaaccagcgcctcccaagcagctgcctatagctggctctataactgagcctggggaagatctttgcctttgacctggatgccaggcggctggcatccatggccacgctgctggcctgggctggcgtctcctgctgtgagctggctgaggaggacttcctggcggtctcccccttagatccgcgctatcgtgaggtccactatgtcctgctggatccttcctgcagtggctcggggagatggtgagaaggcgtggctgagggactcagaggtccacagcagcttagacctggagtcatctgttttggtcttagttctgacactttaatgggcttgggaccctggagcaaaagttctcctctgtgaagcgaggatttcaggagcgaggatttcaggactgaggcagcctgtgaagctgtgtaaccgagacacgcttttccttagcggctcgtctactccatgtgctccctctgccaggaggagaatgaagacatggtacaagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacctcagcctcacaggccaaagcatcagcaccagaacgcacacccagcccagccccaaagagaaagaagagagcaaaaagctgcagccggtgcttgcacaccgccttgcacatagcagaggctccgggctcactccttcctggtgggaaaggaagatgcctgtcctctccgtggaggaccctgggccctcaccgcaggcagcagtttgcgttttgaaaggttattgggtcccttcctcgggctgtgttcttgctggtgagcaaaagtgttgcctgcagaaataaaatgcagaacgtactctac

SEQ ID NO: 286371 - DNA, 1291 bp, Homo sapiens
aggcgtccagctgcacttcccacttctgactctgtgcctgctgttccctgctgggaagaagaaaagccagtgatgctggcttgaggccatagtgggaggcccagtggatcctgagaagctagcccgggcagtgagtgtggatggcttggcaggtgagcctgctggagctggaggactggcttcagtgtcccatctgcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgaaaaaccggacccgaatcgtcaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggaaatgaggaccaccatgagttcatctggaagttccactccatggcctccaggtaataaccttggagagagctcagccagggtctggtggctgcgggcacgggcatctcagctccactggttcctccattcagcttaaccagcgcctcccaagcagctgcctatagctggctctataactgagcctggggaagatagaggaaagtcacgtccctgccttcaagggtctcgcagacaggtggggaggcagatggtgaactgtgggtacctagaacagcagaagttcactcaagctacagaaatactagaggagggtagctcatgcctgcaatcccagtactttgggaggccaaggcaggagtattgctggaggccgggagttcgagaccagcctggccaatgtagtaacacccccgtctctacaaaaaatacaaaaataaaaaaattagttggga

SEQ ID NO: 286372 - DNA, 1012 bp, Homo sapiens
cgcgcgggaacatggggctgtacgctgcggtggcaggcgtgctggccggcgtggagagccgccagggctctatcaaggggctggtgtactccagcaacttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggacccccgccaggctcccatgtcatggatgcctgtgccaccccaggcaataaagaccagtcacttggctgctcttctgaagaaccaagggtatgccgagcagacagctggaggagcccggggcagggacacctagcccggtgcgtctgcatgccctggcagggttccagcagcgagccctgtgccacgcgctcactttcccttccctgcagcggctcgtctactccatgtgctccctctgccaggaggagaatgaagacatggtacaagatgcgctgcagcagaacccgggcgccttcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacctcagcctcacaggccaaagcatcagcaccagaacgcacacccagcccagccccaaagagaaagaagagagcaaaaagctgcagccggtgcttgcacaccgccttgcacatagcagaggctccgggctcactccttcctggtgggaaaggaagatgcctgtcctctccgtggaggaccctgggccctcaccgcaggcagcagtttgcgttttgaaaggttattgggtcccttcctcgggctgtgttcttgctggtgagcaaaagtgttgcctgcagaaataaaatgcagaacgtactctac

SEQ ID NO: 286373 - DNA, 150 bp, Homo sapiens
gcgcgcgggaacatggggctgtacgctgcggtggcaggcgtgctggccggcgtggagagccgccagggctctatcaaggggctggtgtactccagcaacttccaggtagcgggcccgcgcgccacaagtaggggtggggggtgaggaacc

SEQ ID NO: 286374 - DNA, 3560 bp, Homo sapiens
ggcggaggttgtgagcaggcctaagcgcggccgccgtggctcctgcgtctcccatcgtgccgtgcgtcccgcgccgcgttcgagttctcggaggggagggggcgttagccccgcgcagccgccggcgtcgccgccatggacctaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggaggtgatgaagcacaagggtcacccgcaggaccccctgctctcccagtttagtgcaatggcccataagtacctgcctgccttagatgagttcccccatcctccaaagaggcttaggtcagacccagacgcgtgccccaccatgcccctgttggccatgctgctccgcgggctgacacagatccagagtcggatcctgggcccggggaggaagtgctgtgcgctggccaacctggctgacatgctgactgtgtttgcgctgacagaggacgacccccaggaggtgtctgcaaccgtgtatctggacaaactggccacggtgatctctgtgtggaactcggacacccagaatccctaccaccagcaggcgctggcagagaaggtgaaggaggcagaacgggatgtcagcctgacctcgctggccaaactccccagtgagaccattttcgtgggctgcgagttcctgcaccacctgctgcgggagtggggggaggagttgcaggccgtgctccgcagcagccaggggacaagttacgacagctaccggctgtgcgacagtctgacttccttcagccagaacgcgacgctctacctgaaccgcaccagcctgtccaaggaggacaggcaggtggtctctgagctggcggagtgtgtcagggacttcctgaggaaaacgagcacggtgctgaagaacagggccttggaggatatcacagcttccattgccatggccgtcatccagcagaagatggaccgccatatggaagtgtgctacatttttgcctctgagaagaagtgggccttctcggacgagtgggtagcctgcctggggagtaacagggccctcttccgagagccagacttggtgttgaggctgctggaaacagtgatagacgtcagcacagctgacagagccatccctgagtctcagatccggcaggtgatccacctgatcctggaatgttacgcagacctctccctgccaggtaaaaataaagtccttgcaggtatcctgcgttcctgggggcgaaagggcctctctgaaaagttgctggcttatgtggagggttttcaggaagacctcaatacaacttttaaccagctcactcagagtgcctccgaacagggcttggcaaaagctgtggcctccgtggcccgcctggtcatagtgcacccggaagtcacggtgaagaaaatgtgcagcctggctgtggtcaatctcggcacccacaagttcctgggccagattctcactgccttccctgcccttaggtttgtggaagagcagggtcccaattcatctgccactttcatggtgtcatgcctcaaagaaaccgtctggatgaagttctctacacccaaggaagaaaagcaatttttagagctcctgaactgcctgatgagtcccgtgaaaccccaagggattccagtggctgctcttcttgagccagacgaggtgctgaaggaatttgtcctgcctttcttgaggttagatgttgaagaggtagacctcagtctgaggatcttcatccagactctagaggcaaacgcgtgccgagaggaatactggctccagacctgctccccgtttccactcctcttcagcttgtgccagctcttggaccgcttcagcaaatactggcagcttcccaaggagaagcggtgcctctctttggataggaaggatctagcgatccatatcctggagctcctgtgtgagattgtatcagccaatgctgagaccttctccccggatgtctggatcaagtccctgtcctggctccaccgcaagttagaacagctagactggactgtgggcctgaggctgaagagcttcttcgaggggcacttcaagtgtgaagtgccagccacactttttgagatctgtaagctttcagaagacgagtggacctcccaggcccacccagggtacggggctggcacggggctcctggcctggatggagtgctgctgcgtctccagcggcatctcggagaggatgctgtctctcttggtggtggacgtgggcaatcctgaggaggtcagactgttcagcaaaggctttctggtggccctggtgcaagtcatgccttggtgcagccctcaggagtggcagcgccttcaccagctgaccaggagactgctggagaagcagctcctccatgtcccttatagcctggaatatattcagtttgttcccctgctcaacctgaagccctttgcccaggagttgcaactctccgtcctcttcctgaggactttccagtttctctgcagccatagctgtcgtaattggcttcctctggaaggctggaaccacgtggtcaaactcctctgtggcagtctgacccgcctcctggactcagtcagggcgatacaggcagctggcccttgggttcaaggaccagagcaggacctgacccaggaagccctgtttgtttacacccaggtgttctgccatgctctgcacatcatggccatgctccacccggaggtctgtgagccactctacgttttagccttggaaaccctcacctgctatgagactttgagcaagaccaacccttctgtcagctccttgctccagagggcacacgagcagtgcttcttaaagtccattgctgagggcatcggccctgaagaacggcgccaaaccctgttgcagaagatgagcagcttctgacttggcgtggggagctgggccccaacatggcgggtctgcagaagatcagcagcttcttacctgtgcgggagcgaaaaagctgggcttcaacatggcaggtctgtaggggtcagacccgagcagcctggactttacagttatgtgaaactgtccacaaaaagtcatggcaataatggtgtaaagaaaatagtttcttgggtatttgtaacgtacaaactatcataaaaattctcctctttcgcatctca

SEQ ID NO: 286375 - DNA, 5727 bp, Homo sapiens
  misc_feature (1050)..(1050): n is a, c, g, or t
  misc_feature (1138)..(1138): n is a, c, g, or t
  misc_feature (1321)..(1321): n is a, c, g, or t
  misc_feature (2189)..(2189): n is a, c, g, or t
atggtccttagtctcctggagtcagtgttttctctgctggtgtctggcctgtgaaaatggggaatatgagctcttgggggcatgacagactgaggaaggagtagcatctctcactcctgggaaaggggagatgactcaggaatgaggaatagggagcagtgtttgcaccctcgttttagtttctgggccaaaggaaacatacctgataaagacctacatcctttgatgtttctgagctgggggaggcaaagaatagtgacaagattctggtcttgccaaccatgaaaaggtttggggaaaccaacatttactgagcacctaattagactctgtaactggattcttactgtagctctatctcatttatccatcatagcgtcccggggagatggggtcaggagatagcagtgccaacccactagcaagggcttgactggtatatatcacatgatccccaaaggcataacatgaagtctgtattatccccacatatgcagaaggaaggcttggagaagcaatctgaccaagatcacatccctttttttttttcggagatggagggggagtctcactgtgttaccccagctagtcttgaactcctggcctcagggatccacctgcctcagccccccaagtagctgggattacaagtgctagccactgaacctggccagaatcacatcatttttaaatggctgaactaggatttaaacccatgtctgattaaacatcccaagatgttttccatggtaagtctgtgtcaatcgttagttccctgaaggaaggcttaatctagcacagtattttctgtatctactccctggtttctcccacagagctagggccatgagtaccttgtttttgactggaaggagctgtggggtggaccgtttccctgaaagctagaagaatgtttgaagcctgttcccaaggcaagtttataaagagtgaaggcagggcttgtctgattccttctgtgcccattgctctgtggctatgtgattgctctgtgcccattaccctgtggctgtgtgactgctgctgtgcccnttaccctgtggctgcgtgattgctgctgtgcccattaccctgtggctgtgtgattgctctgtgcccattatcctgtggccgtgtgatngctctgtgcccattaccctgtagccgtgtgattgctgctgtgcccattaccttgtggctgtgtgattgctgctgtgcccattatcctgtggccgtgtgattgctctgtgcccattatcctgtggccgtgtgattgctctgtgcccattatcctgtggccgtgtgattgctctgtgcccattancctgtggccgtgtgattgctgctgtgcccattaccctgtggccgtgtgattgctctgtgcccattatcctgtggccgtgtgattgctctgtgcccattatcctgtggctgtgtgattgctctgtgcccattatcctgtagccgtgtgattgcttctgtgcccattaccctgtggctgtgtgattgctgctgtgcccattatcctgtggctgtgtgattgctgctgtgcccattaccctgtggctgtgtgattgctctgtgcccattaccctgtggctgtgtgattgctctgtgcccattatcctgtggccgtgtgattgctgctgtgcctgttaccctgtggctgtgtgattgctctgtgcccattaccctgtggctatgctcccttcatctgtcatgagaagctcagctgtcatgtcctgtggtacatgctcagtggcccctgtagtttgtactgtcctcctatttctaaacccctctccccacatcctctgctggcccagcctttgctggagggtctcgcctcagcagcccagctttttcttttcacacacttttcctgaaggatctcattcaccgtcttggttccggtgatcccctctgggcagatacctctcagaatcacatttcccagcttacttccctcctgaacttccacctggcatttccgttgctggaggacatctgtaccttgatggccaaagctgaactcatctttcctcacacctgctctgattctcctccattccctgtatgtgatgtcacctggtggcctcccagttcccaggctggagagctcggaagccattctggattcctcggccaagtccttctgactccagctgtgcagtggctcttgtagtcatccnttctccccgtccgctgatgtcctttaaaacccttgtcatctcaaaccatgacagcctactaacagcagtggccatctggaaacattttcactatactgtcttatttggcttgtctgtgtgcaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggaggtgatgaagcacaagggtcacccgcaggaccccctgctctcccagtttagtgcaatggcccataagtacctgcctgccttagatgagttcccccatcctccaaagaggcttaggtcagacccagacgcgtgccccaccatgcccctgttggccatgctgctccgcgggctgacacagatccagagtcggatcctgggcccggggaggaagtgctgtgcgctggccaacctggctgacatgctgactgtgtttgcgctgacagaggacgacccccaggaggtgtctgcaaccgtgtatctggacaaactggccacggtgatctctgtgtggaactcggacacccagaatccctaccaccagcaggcgctggcagagaaggtgaaggaggcagaacgggatgtcagcctgacctcgctggccaaactccccagtgagaccattttcgtgggctgcgagttcctgcaccacctgctgcgggagtggggggaggagttgcaggccgtgctccgcagcagccaggggacaagttacgacagctaccggctgtgcgacagtctgacttccttcagccagaacgcgacgctctacctgaaccgcaccagcctgtccaaggaggacaggcaggtggtctctgagctggcggagtgtgtcagggacttcctgaggaaaacgagcacggtgctgaagaacagggccttggaggatatcacagcttccattgccatggccgtcatccagcagaagatggaccgccatatggaagtgtgctacatttttgcctctgagaagaagtgggccttctcggacgagtgggtagcctgcctggggagtaacagggccctcttccgagagccagacttggtgttgaggctgctggaaacagtgatagacgtcagcacagctgacagagccatccctgagtctcagatccggcaggtgatccacctgatcctggaatgttacgcagacctctccctgccaggtaaaaataaagtccttgcaggtatcctgcgttcctgggggcgaaagggcctctctgaaaagttgctggcttatgtggagggttttcaggaagacctcaatacaacttttaaccagctcactcagagtgcctccgaacagggcttggcaaaagctgtggcctccgtggcccgcctggtcatagtgcacccggaagtcacggtgaagaaaatgtgcagcctggctgtggtcaatctcggcacccacaagttcctgggccagattctcactgccttccctgcccttaggtttgtggaagagcagggtcccaattcatctgccactttcatggtgtcatgcctcaaagaaaccgtctggatgaagttctctacacccaaggaagaaaagcaatttttagagctcctgaactgcctgatgagtcccgtgaaaccccaagggattccagtggctgctcttcttgagccagacgaggtgctgaaggaatttgtcctgcctttcttgaggttagatgttgaagaggtagacctcagtctgaggatcttcatccagactctagaggcaaacgcgtgccgagaggaatactggctccagacctgctccccgtttccactcctcttcagcttgtgccagctcttggaccgcttcagcaaatactggcagcttcccaaggagaagcggtgcctctctttggataggaaggatctagcgatccatatcctggagctcctgtgtgagattgtatcagccaatgctgagaccttctccccggatgtctggatcaagtccctgtcctggctccaccgcaagttagaacagctagactggactgtgggcctgaggctgaagagcttcttcgaggggcacttcaagtgtgaagtgccagccacactttttgagatctgtaagctttcagaagacgagtggacctcccaggcccacccagggtacggggctggcacggggctcctggcctggatggagtgctgctgcgtctccagcggcatctcggagaggatgctgtctctcttggtggtggacgtgggcaatcctgaggaggtcagactgttcagcaaaggctttctggtggccctggtgcaagtcatgccttggtgcagccctcaggagtggcagcgccttcaccagctgaccaggagactgctggagaagcagctcctccatgtcccttatagcctggaatatattcagtttgttcccctgctcaacctgaagccctttgcccaggagttgcaactctccgtcctcttcctgaggactttccagtttctctgcagccatagctgtcgtaattggcttcctctggaaggctggaaccacgtggtcaaactcctctgtggcagtctgacccgcctcctggactcagtcagggcgatacaggcagctggcccttgggttcaaggaccagagcaggacctgacccaggaagccctgtttgtttacacccaggtgttctgccatgctctgcacatcatggccatgctccacccggaggtctgtgagccactctacgttttagccttggaaaccctcacctgctatgagactttgagcaagaccaacccttctgtcagctccttgctccagagggcacacgagcagtgcttcttaaagtccattgctgagggcatcggccctgaagaacggcgccaaaccctgttgcagaagatgagcagcttctgacttggcgtggggagctgggccccaacatggcgggtctgcagaagatcagcagcttcttacctgtgcgggagcgaaaaagctgggcttcaacatggcaggtctgtaggggtcagacccgagcagcctggactttacagttatgtgaaactgtccacaaaaagtcatggcaataatggtgtaaagaaaatagtttcttgggtatttgtaacgtacaaactatcataaaaattctcctctttcgcatctca

SEQ ID NO: 286376 - DNA, 5518 bp, Homo sapiens
  misc_feature (841)..(841): n is a, c, g, or t
  misc_feature (929)..(929): n is a, c, g, or t
  misc_feature (1112)..(1112): n is a, c, g, or t
  misc_feature (1980)..(1980): n is a, c, g, or t
ggcggaggttgtgagcaggcctaagcgcggccgccgtggctcctgcgtctcccatcgtgccgtgcgtcccgcgccgcgttcgagttctcggaggggagggggcgttagccccgcgcagccgccggcgtcgccgccatggacctaggtgggtgccgcggctccccggccccgggctgcgtccagcaatgcgccaccagagcggtgctgccccgtcgcgtctcctcctgtcgcgcacgctcgcgcgggcccggaccgaaacgtcccccgcgtcggggcgggtctaggggtcccggggtggccttggcggggggtggtccgggtcccgccgcgcgttgggccgcgtcttgccgcctccggccccctgcgcttgaaaacacggagcagacgtgaagttagagcccttggaagcgcccggggctcgcgcacgtgctttgggaaacgggctccctccgagcacccctgggcgccccgacggcctcatttcctgaacggcagctgcgttcttgagcaagtgtcttaacgctccaagtgtcttacgctcatgacgtttcctcatcgacagagcggggagaatggaagtgtgtctccccactgagttttgggcgactttgcattgagatcgccgagagctagggccatgagtaccttgtttttgactggaaggagctgtggggtggaccgtttccctgaaagctagaagaatgtttgaagcctgttcccaaggcaagtttataaagagtgaaggcagggcttgtctgattccttctgtgcccattgctctgtggctatgtgattgctctgtgcccattaccctgtggctgtgtgactgctgctgtgcccnttaccctgtggctgcgtgattgctgctgtgcccattaccctgtggctgtgtgattgctctgtgcccattatcctgtggccgtgtgatngctctgtgcccattaccctgtagccgtgtgattgctgctgtgcccattaccttgtggctgtgtgattgctgctgtgcccattatcctgtggccgtgtgattgctctgtgcccattatcctgtggccgtgtgattgctctgtgcccattatcctgtggccgtgtgattgctctgtgcccattancctgtggccgtgtgattgctgctgtgcccattaccctgtggccgtgtgattgctctgtgcccattatcctgtggccgtgtgattgctctgtgcccattatcctgtggctgtgtgattgctctgtgcccattatcctgtagccgtgtgattgcttctgtgcccattaccctgtggctgtgtgattgctgctgtgcccattatcctgtggctgtgtgattgctgctgtgcccattaccctgtggctgtgtgattgctctgtgcccattaccctgtggctgtgtgattgctctgtgcccattatcctgtggccgtgtgattgctgctgtgcctgttaccctgtggctgtgtgattgctctgtgcccattaccctgtggctatgctcccttcatctgtcatgagaagctcagctgtcatgtcctgtggtacatgctcagtggcccctgtagtttgtactgtcctcctatttctaaacccctctccccacatcctctgctggcccagcctttgctggagggtctcgcctcagcagcccagctttttcttttcacacacttttcctgaaggatctcattcaccgtcttggttccggtgatcccctctgggcagatacctctcagaatcacatttcccagcttacttccctcctgaacttccacctggcatttccgttgctggaggacatctgtaccttgatggccaaagctgaactcatctttcctcacacctgctctgattctcctccattccctgtatgtgatgtcacctggtggcctcccagttcccaggctggagagctcggaagccattctggattcctcggccaagtccttctgactccagctgtgcagtggctcttgtagtcatccnttctccccgtccgctgatgtcctttaaaacccttgtcatctcaaaccatgacagcctactaacagcagtggccatctggaaacattttcactatactgtcttatttggcttgtctgtgtgcaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggaggtgatgaagcacaagggtcacccgcaggaccccctgctctcccagtttagtgcaatggcccataagtacctgcctgccttagatgagttcccccatcctccaaagaggcttaggtcagacccagacgcgtgccccaccatgcccctgttggccatgctgctccgcgggctgacacagatccagagtcggatcctgggcccggggaggaagtgctgtgcgctggccaacctggctgacatgctgactgtgtttgcgctgacagaggacgacccccaggaggtgtctgcaaccgtgtatctggacaaactggccacggtgatctctgtgtggaactcggacacccagaatccctaccaccagcaggcgctggcagagaaggtgaaggaggcagaacgggatgtcagcctgacctcgctggccaaactccccagtgagaccattttcgtgggctgcgagttcctgcaccacctgctgcgggagtggggggaggagttgcaggccgtgctccgcagcagccaggggacaagttacgacagctaccggctgtgcgacagtctgacttccttcagccagaacgcgacgctctacctgaaccgcaccagcctgtccaaggaggacaggcaggtggtctctgagctggcggagtgtgtcagggacttcctgaggaaaacgagcacggtgctgaagaacagggccttggaggatatcacagcttccattgccatggccgtcatccagcagaagatggaccgccatatggaagtgtgctacatttttgcctctgagaagaagtgggccttctcggacgagtgggtagcctgcctggggagtaacagggccctcttccgagagccagacttggtgttgaggctgctggaaacagtgatagacgtcagcacagctgacagagccatccctgagtctcagatccggcaggtgatccacctgatcctggaatgttacgcagacctctccctgccaggtaaaaataaagtccttgcaggtatcctgcgttcctgggggcgaaagggcctctctgaaaagttgctggcttatgtggagggttttcaggaagacctcaatacaacttttaaccagctcactcagagtgcctccgaacagggcttggcaaaagctgtggcctccgtggcccgcctggtcatagtgcacccggaagtcacggtgaagaaaatgtgcagcctggctgtggtcaatctcggcacccacaagttcctgggccagattctcactgccttccctgcccttaggtttgtggaagagcagggtcccaattcatctgccactttcatggtgtcatgcctcaaagaaaccgtctggatgaagttctctacacccaaggaagaaaagcaatttttagagctcctgaactgcctgatgagtcccgtgaaaccccaagggattccagtggctgctcttcttgagccagacgaggtgctgaaggaatttgtcctgcctttcttgaggttagatgttgaagaggtagacctcagtctgaggatcttcatccagactctagaggcaaacgcgtgccgagaggaatactggctccagacctgctccccgtttccactcctcttcagcttgtgccagctcttggaccgcttcagcaaatactggcagcttcccaaggagaagcggtgcctctctttggataggaaggatctagcgatccatatcctggagctcctgtgtgagattgtatcagccaatgctgagaccttctccccggatgtctggatcaagtccctgtcctggctccaccgcaagttagaacagctagactggactgtgggcctgaggctgaagagcttcttcgaggggcacttcaagtgtgaagtgccagccacactttttgagatctgtaagctttcagaagacgagtggacctcccaggcccacccagggtacggggctggcacggggctcctggcctggatggagtgctgctgcgtctccagcggcatctcggagaggatgctgtctctcttggtggtggacgtgggcaatcctgaggaggtcagactgttcagcaaaggctttctggtggccctggtgcaagtcatgccttggtgcagccctcaggagtggcagcgccttcaccagctgaccaggagactgctggagaagcagctcctccatgtcccttatagcctggaatatattcagtttgttcccctgctcaacctgaagccctttgcccaggagttgcaactctccgtcctcttcctgaggactttccagtttctctgcagccatagctgtcgtaattggcttcctctggaaggctggaaccacgtggtcaaactcctctgtggcagtctgacccgcctcctggactcagtcagggcgatacaggcagctggcccttgggttcaaggaccagagcaggacctgacccaggaagccctgtttgtttacacccaggtgttctgccatgctctgcacatcatggccatgctccacccggaggtctgtgagccactctacgttttagccttggaaaccctcacctgctatgagactttgagcaagaccaacccttctgtcagctccttgctccagagggcacacgagcagtgcttcttaaagtccattgctgagggcatcggccctgaagaacggcgccaaaccctgttgcagaagatgagcagcttctgacttggcgtggggagctgggccccaacatggcgggtctgcagaagatcagcagcttcttacctgtgcgggagcgaaaaagctgggcttcaacatggcaggtctgtaggggtcagacccgagcagcctggactttacagttatgtgaaactgtccacaaaaagtcatggcaataatggtgtaaagaaaatagtttcttgggtatttgtaacgtacaaactatcataaaaattctcctctttcgcatctca

SEQ ID NO: 286377 - DNA, 3656 bp, Homo sapiens
ggcggaggttgtgagcaggcctaagcgcggccgccgtggctcctgcgtctcccatcgtgccgtgcgtcccgcgccgcgttcgagttctcggaggggagggggcgttagccccgcgcagccgccggcgtcgccgccatggacctagagctagggccatgagtaccttgtttttgactggaaggagctgtggggtggaccgtttccctgaaagctagaagaatgtttgaagcctgttcccaaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggaggtgatgaagcacaagggtcacccgcaggaccccctgctctcccagtttagtgcaatggcccataagtacctgcctgccttagatgagttcccccatcctccaaagaggcttaggtcagacccagacgcgtgccccaccatgcccctgttggccatgctgctccgcgggctgacacagatccagagtcggatcctgggcccggggaggaagtgctgtgcgctggccaacctggctgacatgctgactgtgtttgcgctgacagaggacgacccccaggaggtgtctgcaaccgtgtatctggacaaactggccacggtgatctctgtgtggaactcggacacccagaatccctaccaccagcaggcgctggcagagaaggtgaaggaggcagaacgggatgtcagcctgacctcgctggccaaactccccagtgagaccattttcgtgggctgcgagttcctgcaccacctgctgcgggagtggggggaggagttgcaggccgtgctccgcagcagccaggggacaagttacgacagctaccggctgtgcgacagtctgacttccttcagccagaacgcgacgctctacctgaaccgcaccagcctgtccaaggaggacaggcaggtggtctctgagctggcggagtgtgtcagggacttcctgaggaaaacgagcacggtgctgaagaacagggccttggaggatatcacagcttccattgccatggccgtcatccagcagaagatggaccgccatatggaagtgtgctacatttttgcctctgagaagaagtgggccttctcggacgagtgggtagcctgcctggggagtaacagggccctcttccgagagccagacttggtgttgaggctgctggaaacagtgatagacgtcagcacagctgacagagccatccctgagtctcagatccggcaggtgatccacctgatcctggaatgttacgcagacctctccctgccaggtaaaaataaagtccttgcaggtatcctgcgttcctgggggcgaaagggcctctctgaaaagttgctggcttatgtggagggttttcaggaagacctcaatacaacttttaaccagctcactcagagtgcctccgaacagggcttggcaaaagctgtggcctccgtggcccgcctggtcatagtgcacccggaagtcacggtgaagaaaatgtgcagcctggctgtggtcaatctcggcacccacaagttcctgggccagattctcactgccttccctgcccttaggtttgtggaagagcagggtcccaattcatctgccactttcatggtgtcatgcctcaaagaaaccgtctggatgaagttctctacacccaaggaagaaaagcaatttttagagctcctgaactgcctgatgagtcccgtgaaaccccaagggattccagtggctgctcttcttgagccagacgaggtgctgaaggaatttgtcctgcctttcttgaggttagatgttgaagaggtagacctcagtctgaggatcttcatccagactctagaggcaaacgcgtgccgagaggaatactggctccagacctgctccccgtttccactcctcttcagcttgtgccagctcttggaccgcttcagcaaatactggcagcttcccaaggagaagcggtgcctctctttggataggaaggatctagcgatccatatcctggagctcctgtgtgagattgtatcagccaatgctgagaccttctccccggatgtctggatcaagtccctgtcctggctccaccgcaagttagaacagctagactggactgtgggcctgaggctgaagagcttcttcgaggggcacttcaagtgtgaagtgccagccacactttttgagatctgtaagctttcagaagacgagtggacctcccaggcccacccagggtacggggctggcacggggctcctggcctggatggagtgctgctgcgtctccagcggcatctcggagaggatgctgtctctcttggtggtggacgtgggcaatcctgaggaggtcagactgttcagcaaaggctttctggtggccctggtgcaagtcatgccttggtgcagccctcaggagtggcagcgccttcaccagctgaccaggagactgctggagaagcagctcctccatgtcccttatagcctggaatatattcagtttgttcccctgctcaacctgaagccctttgcccaggagttgcaactctccgtcctcttcctgaggactttccagtttctctgcagccatagctgtcgtaattggcttcctctggaaggctggaaccacgtggtcaaactcctctgtggcagtctgacccgcctcctggactcagtcagggcgatacaggcagctggcccttgggttcaaggaccagagcaggacctgacccaggaagccctgtttgtttacacccaggtgttctgccatgctctgcacatcatggccatgctccacccggaggtctgtgagccactctacgttttagccttggaaaccctcacctgctatgagactttgagcaagaccaacccttctgtcagctccttgctccagagggcacacgagcagtgcttcttaaagtccattgctgagggcatcggccctgaagaacggcgccaaaccctgttgcagaagatgagcagcttctgacttggcgtggggagctgggccccaacatggcgggtctgcagaagatcagcagcttcttacctgtgcgggagcgaaaaagctgggcttcaacatggcaggtctgtaggggtcagacccgagcagcctggactttacagttatgtgaaactgtccacaaaaagtcatggcaataatggtgtaaagaaaatagtttcttgggtatttgtaacgtacaaactatcataaaaattctcctctttcgcatctca

SEQ ID NO: 286378 - DNA, 4138 bp, Homo sapiens
ggcggaggttgtgagcaggcctaagcgcggccgccgtggctcctgcgtctcccatcgtgccgtgcgtcccgcgccgcgttcgagttctcggaggggagggggcgttagccccgcgcagccgccggcgtcgccgccatggacctaggtgggtgccgcggctccccggccccgggctgcgtccagcaatgcgccaccagagcggtgctgccccgtcgcgtctcctcctgtcgcgcacgctcgcgcgggcccggaccgaaacgtcccccgcgtcggggcgggtctaggggtcccggggtggccttggcggggggtggtccgggtcccgccgcgcgttgggccgcgtcttgccgcctccggccccctgcgcttgaaaacacggagcagacgtgaagttagagcccttggaagcgcccggggctcgcgcacgtgctttgggaaacgggctccctccgagcacccctgggcgccccgacggcctcatttcctgaacggcagctgcgttcttgagcaagtgtcttaacgctccaagtgtcttacgctcatgacgtttcctcatcgacagagcggggagaatggaagtgtgtctccccactgagttttgggcgactttgcattgagatcgccgagagctagggccatgagtaccttgtttttgactggaaggagctgtggggtggaccgtttccctgaaagctagaagaatgtttgaagcctgttcccaaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggaggtgatgaagcacaagggtcacccgcaggaccccctgctctcccagtttagtgcaatggcccataagtacctgcctgccttagatgagttcccccatcctccaaagaggcttaggtcagacccagacgcgtgccccaccatgcccctgttggccatgctgctccgcgggctgacacagatccagagtcggatcctgggcccggggaggaagtgctgtgcgctggccaacctggctgacatgctgactgtgtttgcgctgacagaggacgacccccaggaggtgtctgcaaccgtgtatctggacaaactggccacggtgatctctgtgtggaactcggacacccagaatccctaccaccagcaggcgctggcagagaaggtgaaggaggcagaacgggatgtcagcctgacctcgctggccaaactccccagtgagaccattttcgtgggctgcgagttcctgcaccacctgctgcgggagtggggggaggagttgcaggccgtgctccgcagcagccaggggacaagttacgacagctaccggctgtgcgacagtctgacttccttcagccagaacgcgacgctctacctgaaccgcaccagcctgtccaaggaggacaggcaggtggtctctgagctggcggagtgtgtcagggacttcctgaggaaaacgagcacggtgctgaagaacagggccttggaggatatcacagcttccattgccatggccgtcatccagcagaagatggaccgccatatggaagtgtgctacatttttgcctctgagaagaagtgggccttctcggacgagtgggtagcctgcctggggagtaacagggccctcttccgagagccagacttggtgttgaggctgctggaaacagtgatagacgtcagcacagctgacagagccatccctgagtctcagatccggcaggtgatccacctgatcctggaatgttacgcagacctctccctgccaggtaaaaataaagtccttgcaggtatcctgcgttcctgggggcgaaagggcctctctgaaaagttgctggcttatgtggagggttttcaggaagacctcaatacaacttttaaccagctcactcagagtgcctccgaacagggcttggcaaaagctgtggcctccgtggcccgcctggtcatagtgcacccggaagtcacggtgaagaaaatgtgcagcctggctgtggtcaatctcggcacccacaagttcctgggccagattctcactgccttccctgcccttaggtttgtggaagagcagggtcccaattcatctgccactttcatggtgtcatgcctcaaagaaaccgtctggatgaagttctctacacccaaggaagaaaagcaatttttagagctcctgaactgcctgatgagtcccgtgaaaccccaagggattccagtggctgctcttcttgagccagacgaggtgctgaaggaatttgtcctgcctttcttgaggttagatgttgaagaggtagacctcagtctgaggatcttcatccagactctagaggcaaacgcgtgccgagaggaatactggctccagacctgctccccgtttccactcctcttcagcttgtgccagctcttggaccgcttcagcaaatactggcagcttcccaaggagaagcggtgcctctctttggataggaaggatctagcgatccatatcctggagctcctgtgtgagattgtatcagccaatgctgagaccttctccccggatgtctggatcaagtccctgtcctggctccaccgcaagttagaacagctagactggactgtgggcctgaggctgaagagcttcttcgaggggcacttcaagtgtgaagtgccagccacactttttgagatctgtaagctttcagaagacgagtggacctcccaggcccacccagggtacggggctggcacggggctcctggcctggatggagtgctgctgcgtctccagcggcatctcggagaggatgctgtctctcttggtggtggacgtgggcaatcctgaggaggtcagactgttcagcaaaggctttctggtggccctggtgcaagtcatgccttggtgcagccctcaggagtggcagcgccttcaccagctgaccaggagactgctggagaagcagctcctccatgtcccttatagcctggaatatattcagtttgttcccctgctcaacctgaagccctttgcccaggagttgcaactctccgtcctcttcctgaggactttccagtttctctgcagccatagctgtcgtaattggcttcctctggaaggctggaaccacgtggtcaaactcctctgtggcagtctgacccgcctcctggactcagtcagggcgatacaggcagctggcccttgggttcaaggaccagagcaggacctgacccaggaagccctgtttgtttacacccaggtgttctgccatgctctgcacatcatggccatgctccacccggaggtctgtgagccactctacgttttagccttggaaaccctcacctgctatgagactttgagcaagaccaacccttctgtcagctccttgctccagagggcacacgagcagtgcttcttaaagtccattgctgagggcatcggccctgaagaacggcgccaaaccctgttgcagaagatgagcagcttctgacttggcgtggggagctgggccccaacatggcgggtctgcagaagatcagcagcttcttacctgtgcgggagcgaaaaagctgggcttcaacatggcaggtctgtaggggtcagacccgagcagcctggactttacagttatgtgaaactgtccacaaaaagtcatggcaataatggtgtaaagaaaatagtttcttgggtatttgtaacgtacaaactatcataaaaattctcctctttcgcatctca

SEQ ID NO: 286379 - DNA, 3298 bp, Homo sapiens
ggcggaggttgtgagcaggcctaagcgcggccgccgtggctcctgcgtctcccatcgtgccgtgcgtcccgcgccgcgttcgagttctcggaggggagggggcgttagccccgcgcagccgccggcgtcgccgccatggacctaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggagaggacgacccccaggaggtgtctgcaaccgtgtatctggacaaactggccacggtgatctctgtgtggaactcggacacccagaatccctaccaccagcaggcgctggcagagaaggtgaaggaggcagaacgggatgtcagcctgacctcgctggccaaactccccagtgagaccattttcgtgggctgcgagttcctgcaccacctgctgcgggagtggggggaggagttgcaggccgtgctccgcagcagccaggggacaagttacgacagctaccggctgtgcgacagtctgacttccttcagccagaacgcgacgctctacctgaaccgcaccagcctgtccaaggaggacaggcaggtggtctctgagctggcggagtgtgtcagggacttcctgaggaaaacgagcacggtgctgaagaacagggccttggaggatatcacagcttccattgccatggccgtcatccagcagaagatggaccgccatatggaagtgtgctacatttttgcctctgagaagaagtgggccttctcggacgagtgggtagcctgcctggggagtaacagggccctcttccgagagccagacttggtgttgaggctgctggaaacagtgatagacgtcagcacagctgacagagccatccctgagtctcagatccggcaggtgatccacctgatcctggaatgttacgcagacctctccctgccaggtaaaaataaagtccttgcaggtatcctgcgttcctgggggcgaaagggcctctctgaaaagttgctggcttatgtggagggttttcaggaagacctcaatacaacttttaaccagctcactcagagtgcctccgaacagggcttggcaaaagctgtggcctccgtggcccgcctggtcatagtgcacccggaagtcacggtgaagaaaatgtgcagcctggctgtggtcaatctcggcacccacaagttcctgggccagattctcactgccttccctgcccttaggtttgtggaagagcagggtcccaattcatctgccactttcatggtgtcatgcctcaaagaaaccgtctggatgaagttctctacacccaaggaagaaaagcaatttttagagctcctgaactgcctgatgagtcccgtgaaaccccaagggattccagtggctgctcttcttgagccagacgaggtgctgaaggaatttgtcctgcctttcttgaggttagatgttgaagaggtagacctcagtctgaggatcttcatccagactctagaggcaaacgcgtgccgagaggaatactggctccagacctgctccccgtttccactcctcttcagcttgtgccagctcttggaccgcttcagcaaatactggcagcttcccaaggagaagcggtgcctctctttggataggaaggatctagcgatccatatcctggagctcctgtgtgagattgtatcagccaatgctgagaccttctccccggatgtctggatcaagtccctgtcctggctccaccgcaagttagaacagctagactggactgtgggcctgaggctgaagagcttcttcgaggggcacttcaagtgtgaagtgccagccacactttttgagatctgtaagctttcagaagacgagtggacctcccaggcccacccagggtacggggctggcacggggctcctggcctggatggagtgctgctgcgtctccagcggcatctcggagaggatgctgtctctcttggtggtggacgtgggcaatcctgaggaggtcagactgttcagcaaaggctttctggtggccctggtgcaagtcatgccttggtgcagccctcaggagtggcagcgccttcaccagctgaccaggagactgctggagaagcagctcctccatgtcccttatagcctggaatatattcagtttgttcccctgctcaacctgaagccctttgcccaggagttgcaactctccgtcctcttcctgaggactttccagtttctctgcagccatagctgtcgtaattggcttcctctggaaggctggaaccacgtggtcaaactcctctgtggcagtctgacccgcctcctggactcagtcagggcgatacaggcagctggcccttgggttcaaggaccagagcaggacctgacccaggaagccctgtttgtttacacccaggtgttctgccatgctctgcacatcatggccatgctccacccggaggtctgtgagccactctacgttttagccttggaaaccctcacctgctatgagactttgagcaagaccaacccttctgtcagctccttgctccagagggcacacgagcagtgcttcttaaagtccattgctgagggcatcggccctgaagaacggcgccaaaccctgttgcagaagatgagcagcttctgacttggcgtggggagctgggccccaacatggcgggtctgcagaagatcagcagcttcttacctgtgcgggagcgaaaaagctgggcttcaacatggcaggtctgtaggggtcagacccgagcagcctggactttacagttatgtgaaactgtccacaaaaagtcatggcaataatggtgtaaagaaaatagtttcttgggtatttgtaacgtacaaactatcataaaaattctcctctttcgcatctca

SEQ ID NO: 286380 - DNA, 3829 bp, Homo sapiens
ggcggaggttgtgagcaggcctaagcgcggccgccgtggctcctgcgtctcccatcgtgccgtgcgtcccgcgccgcgttcgagttctcggaggggagggggcgttagccccgcgcagccgccggcgtcgccgccatggacctaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggaggtgatgaagcacaagggtcacccgcaggaccccctgctctcccagtttagtgcaatggcccataagtacctgcctgccttagatgagttcccccatcctccaaagaggcttaggtcagacccagacgcgtgccccaccatgcccctgttggccatgctgctccgcgggctgacacagatccagagtcggatcctgggcccggggaggaagtgctgtgcgctggccaacctggctgacatgctgactgtgtttgcgctgacagaggacgacccccaggaggtgtctgcaaccgtgtatctggacaaactggccacggtgatctctgtgtggaactcggacacccagaatccctaccaccagcaggcgctggcagagaaggtgaaggaggcagaacgggatgtcagcctgacctcgctggccaaactccccagtgagaccattttcgtgggctgcgagttcctgcaccacctgctgcgggagtggggggaggagttgcaggccgtgctccgcagcagccaggggacaagttacgacagctaccggctgtgcgacagtctgacttccttcagccagaacgcgacgctctacctgaaccgcaccagcctgtccaaggaggacaggcaggtggtctctgagctggcggagtgtgtcagggacttcctgaggaaaacgagcacggtgctgaagaacagggccttggaggatatcacagcttccattgccatggccgtcatccagcagaagatggaccgccatatggaagtgtgctacatttttgcctctgagaagaagtgggccttctcggacgagtgggtagcctgcctggggagtaacagggccctcttccgagagccagacttggtgttgaggctgctggaaacagtgatagacgtcagcacagctgacagagccatccctgagtctcagatccggcaggtgatccacctgatcctggaatgttacgcagacctctccctgccaggtaaaaataaagtccttgcaggtatcctgcgttcctgggggcgaaagggcctctctgaaaagttgctggcttatgtggagggttttcaggaagacctcaatacaacttttaaccagctcactcagagtgcctccgaacagggcttggcaaaagctgtggcctccgtggcccgcctggtcatagtgcacccggaagtcacggtgaagaaaatgtgcagcctggctgtggtcaatctcggcacccacaagttcctgggccagattctcactgccttccctgcccttaggtttgtggaagagcagggtcccaattcatctgccactttcatggtgtcatgcctcaaagaaaccgtctggatgaagttctctacacccaaggaagaaaagcaatttttagagctcctgaactgcctgatgagtcccgtgaaaccccaagggattccagtggctgctcttcttgagccagacgaggtgctgaaggaatttgtcctgcctttcttgaggttagatgttgaagaggtagacctcagtctgaggatcttcatccagactctagaggcaaacgcgtgccgagaggaatactggctccagacctgctccccgtttccactcctcttcagcttgtgccagctcttggaccgcttcagcaaatactggcagcttcccaaggagaagcggtgcctctctttggataggaaggatctagcgatccatatcctggagctcctgtgtgagattgtatcagccaatgctgagaccttctccccggatgtctggatcaagtccctgtcctggctccaccgcaagttagaacagctagactggactgtgggcctgaggctgaagagcttcttcgaggggcacttcaagtgtgaagtgccagccacactttttgagatctgtaagctttcagaagacgagtggacctcccaggcccacccagggtacggggctggcacggggctcctggcctggatggagtgctgctgcgtctccagcggcatctcggagaggatgctgtctctcttggtggtggacgtgggcaatcctgaggaggtcagactgttcagcaaaggctttctggtggccctggtgcaagtcatgccttggtgcagccctcaggagtggcagcgccttcaccagctgaccaggagactgctggagaagcagctcctccatgtcccttatagcctggaatatattcagtttgttcccctgctcaacctgaagccctttgcccaggagttgcaactctccgtcctcttcctgaggactttccagtttctctgcagccatagctgtcgtaattggcttcctctggaaggctggaaccacgtggtcaaactcctctgtggcagtctgacccgcctcctggactcagtcagggcgatacaggcagctggcccttgggttcaaggaccagagcaggacctgacccaggaagccctgtttgtttacacccaggtgttctgccatgctctgcacatcatggccatgctccacccggaggtctgtgagccactctacgttttagccttggaaaccctcacctgctatgagactttgagcaagaccaacccttctgtcagctccttgctccagagggcacacgagcagtgcttcttaaagtccattgctgagggcatcggccctgaagaacggcgccaaaccctgttgcagaagatgagcagcttctgacttggcgtggggagctgggccccaacatggcgggtctgcagaagatcagcagcttcttacctgtgcgggagcgaaaaagctgggcttcaacatggcaggtctgtaggggtcagacccgagcagcctggactttacagttatgtgaaactgtccacaaaaagtcatggcaataatggtgtaaagaaaatagtttcttgggtatttgtaacgtacaaactatcataaaaattctcctctttcgcatctcactttgtctcttctaagtcggcctcagcaatagcccaggattaaatatgctctgaaattgggtttagtgtcttcaagatcaaatccagccgggaggaacatgttcataactggacttttccatcctagattttggcaaataagcccaaagttgaaaccatgtgagtggaaaaagcattacatggtacgtataacccccttcaagagttatttcgtcttttaatgtttttttcttgaggtatcttggaaaggacagcagcttggaaaagaa

SEQ ID NO: 286381 - DNA, 3940 bp, Homo sapiens
ggcggaggttgtgagcaggcctaagcgcggccgccgtggctcctgcgtctcccatcgtgccgtgcgtcccgcgccgcgttcgagttctcggaggggagggggcgttagccccgcgcagccgccggcgtcgccgccatggacctaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggaggtgatgaagcacaagggtcacccgcaggaccccctgctctcccagtttagtgcaatggcccataagtacctgcctgccttagatgagttcccccatcctccaaagaggcttaggtcagacccagacgcgtgccccaccatgcccctgttggccatgctgctccgcgggctgacacagatccagagtcggatcctgggcccggggaggaagtgctgtgcgctggccaacctggctgacatgctgactgtgtttgcgctgacagaggacgacccccaggaggtgtctgcaaccgtgtatctggacaaactggccacggtgatctctgtgtggaactcggacacccagaatccctaccaccagcaggcgctggcagagaaggtgaaggaggcagaacgggatgtcagcctgacctcgctggccaaactccccagtgagaccattttcgtgggctgcgagttcctgcaccacctgctgcgggagtggggggaggagttgcaggccgtgctccgcagcagccaggggacaagttacgacagctaccggctgtgcgacagtctgacttccttcagccagaacgcgacgctctacctgaaccgcaccagcctgtccaaggaggacaggcaggtggtctctgagctggcggagtgtgtcagggacttcctgaggaaaacgagcacggtgctgaagaacagggccttggaggatatcacagcttccattgccatggccgtcatccagcagaagatggaccgccatatggaagtgtgctacatttttgcctctgagaagaagtgggccttctcggacgagtgggtagcctgcctggggagtaacagggccctcttccgagagccagacttggtgttgaggctgctggaaacagtgatagacgtcagcacagctgacagagccatccctgagtctcagatccggcaggtgatccacctgatcctggaatgttacgcagacctctccctgccaggtaaaaataaagtccttgcaggtatcctgcgttcctgggggcgaaagggcctctctgaaaagttgctggcttatgtggagggttttcaggaagacctcaatacaacttttaaccagctcactcagagtgcctccgaacagggcttggcaaaagctgtggcctccgtggcccgcctggtcatagtgcacccggaagtcacggtgaagaaaatgtgcagcctggctgtggtcaatctcggcacccacaagttcctgggccagattctcactgccttccctgcccttaggtttgtggaagagcagggtcccaattcatctgccactttcatggtgtcatgcctcaaagaaaccgtctggatgaagttctctacacccaaggaagaaaagcaatttttagagctcctgaactgcctgatgagtcccgtgaaaccccaagggattccagtggctgctcttcttgagccagacgaggtgctgaaggaatttgtcctgcctttcttgaggttagatgttgaagaggtagacctcagtctgaggatcttcatccagactctagaggcaaacgcgtgccgagaggaatactggctccagacctgctccccgtttccactcctcttcagcttgtgccagctcttggaccgcttcagcaaatactggcagcttcccaaggagaagcggtgcctctctttggataggaaggatctagcgatccatatcctggagctcctgtgtgagattgtatcagccaatgctgagaccttctccccggatgtctggatcaagtccctgtcctggctccaccgcaagttagaacagctagactggactgtgggcctgaggctgaagagcttcttcgaggggcacttcaagtgtgaagtgccagccacactttttgagatctgtaagctttcagaagacgagtggacctcccaggcccacccagggtacggggctggcacggggctcctggcctggatggagtgctgctgcgtctccagcggcatctcggagaggatgctgtctctcttggtggtggacgtgggcaatcctgaggaggtcagactgttcagcaaaggctttctggtggccctggtgcaagtcatgccttggtgcagccctcaggagtggcagcgccttcaccagctgaccaggagactgctggagaagcagctcctccatgtcccttatagcctggaatatattcagtttgttcccctgctcaacctgaagccctttgcccaggagttgcaactctccgtcctcttcctgaggactttccagtttctctgcagccatagctgtcgtaattggcttcctctggaaggctggaaccacgtggtcaaactcctctgtggcagtctgacccgcctcctggactcagtcagggcgatacaggcagctggcccttgggttcaaggaccagagcaggacctgacccaggaagccctgtttgtttacacccaggtgttctgccatgctctgcacatcatggccatgctccacccggaggtctgtgagccactctacgttttagccttggaaaccctcacctgctatgagactttgagcaagaccaacccttctgtcagctccttgctccagagggcacacgagcagtgcttcttaaagtccattgctgagggcatcggccctgaagaacggcgccaaaccctgttgcagaagatgagcagcttctgacttggcgtggggagctgggccccaacatggcgggtctgcagaagatcagcagcttcttacctgtgcgggagcgaaaaagctgggcttcaacatggcaggtctgtaggggtcagacccgagcagcctggactttacagttatgtgaaactgtccacaaaaagtcatggcaataatggtgtaaagaaaatagtttcttgggtatttgtaacgtacaaactatcataaaaattctcctctttcgcatctcaaaaaaaaaaaaaaaaaaaaaaaaaaaaaaaaaaaaaaaaaaaaaaaaaaaaaaaaaaaaaaaaaaaaaaaaaaaaaaaaaggggggggggggggaaaaatttcccgggggggggcacaccaatgtcgtcgacgcaccgccacctgttgtgtggtgagacaggagggggcccaccatggaggggaccacgatcaaacaacgacgccggcgccggcgcgcgaaacaacacacacggcgccgccgaggaaacacacccggtgccagtcctcgggagagacgaccccccctgcggggggggagcacatagggggaccacccccgcaaaaaaaacgccgcggggactaaacacgcggggtgactgcggcaaccccgggcatctcg

SEQ ID NO: 286382 - DNA, 3525 bp, Homo sapiens
ggcggaggttgtgagcaggcctaagcgcggccgccgtggctcctgcgtctcccatcgtgccgtgcgtcccgcgccgcgttcgagttctcggaggggagggggcgttagccccgcgcagccgccggcgtcgccgccatggacctaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggaggtgatgaagcacaagggtcacccgcaggaccccctgctctcccagtttagtgcaatggcccataagtacctgcctgccttagatgagttcccccatcctccaaagaggcttaggtcagacccagacgcgtgccccaccatgcccctgttggccatgctgctccgcgggctgacacagatccagagtcggatcctgggcccggggaggaagtgctgtgcgctggccaacctggctgacatgctgactgtgtttgcgctgacagaggacgacccccaggaggtgtctgcaaccgtgtatctggacaaactggccacggtgatctctgtgtggaactcggacacccagaatccctaccaccagcaggcgctggcagagaaggtgaaggaggcagaacgggatgtcagcctgacctcgctggccaaactccccagtgagaccattttcgtgggctgcgagttcctgcaccacctgctgcgggagtggggggaggagttgcaggccgtgctccgcagcagccaggggacaagttacgacagctaccggctgtgcgacagtctgacttccttcagccagaacgcgacgctctacctgaaccgcaccagcctgtccaaggaggacaggcaggtggtctctgagctggcggagtgtgtcagggacttcctgaggaaaacgagcacggtgctgaagaacagggccttggaggatatcacagcttccattgccatggccgtcatccagcagaagatggaccgccatatggaagtgtgctacatttttgcctctgagaagaagtgggccttctcggacgagtgggtagcctgcctggggagtaacagggccctcttccgagagccagacttggtgttgaggctgctggaaacagtgatagacgtcagcacagctgacagagccatccctgagtctcagatccggcaggtgatccacctgatcctggaatgttacgcagacctctccctgccaggtaaaaataaagtccttgcaggtatcctgcgttcctgggggcgaaagggcctctctgaaaagttgctggcttatgtggagggttttcaggaagacctcaatacaacttttaaccagctcactcagagtgcctccgaacagggcttggcaaaagctgtggcctccgtggcccgcctggtcatagtgcacccggaagtcacggtgaagaaaatgtgcagcctggctgtggtcaatctcggcacccacaagttcctgggccagattctcactgccttccctgcccttaggtttgtggaagagcagggtcccaattcatctgccactttcatggtgtcatgcctcaaagaaaccgtctggatgaagttctctacacccaaggaagaaaagcaatttttagagctcctgaactgcctgatgagtcccgtgaaaccccaagggattccagtggctgctcttcttgagccagacgaggtgctgaaggaatttgtcctgcctttcttgaggttagatgttgaagaggtagacctcagtctgaggatcttcatccagactctagaggcaaacgcgtgccgagaggaatactggctccagacctgctccccgtttccactcctcttcagcttgtgccagctcttggaccgcttcagcaaatactggcagcttcccaaggagaagcggtgcctctctttggataggaaggatctagcgatccatatcctggagctcctgtgtgagattgtatcagccaatgctgagaccttctccccggatgtctggatcaagtccctgtcctggctccaccgcaagttagaacagctagactggactgtgggcctgaggctgaagagcttcttcgaggggcacttcaagtgtgaagtgccagccacactttttgagatctgtaagctttcagaagacgagtggacctcccaggcccacccagggtacggggctggcacggggctcctggcctggatggagtgctgctgcgtctccagcggcatctcggagaggatgctgtctctcttggtggtggacgtgggcaatcctgaggaggtcagactgttcagcaaaggctttctggtggccctggtgcaagtcatgccttggtgcagccctcaggagtggcagcgccttcaccagctgaccaggagactgctggagaagcagctcctccatgtcccttatagcctggaatatattcagtttgttcccctgctcaacctgaagccctttgcccaggagttgcaactctccgtcctcttcctgaggactttccagtttctctgcagccatagctgtcgtaattggcttcctctggaaggctggaaccacgtggtcaaactcctctgtggcagtctgacccgcctcctggactcagtcagggcgatacaggcagctggcccttgggttcaaggaccagagcaggacctgacccaggaagccctgtttgtttacacccaggtgttctgccatgctctgcacatcatggccatgctccacccggaggtctgtgagccactctacgttttagccttggaaaccctcacctgctatgagactttgagcaagaccaacccttctgtcagctccttgctccagagggcacacgagcagtgcttcttaaagtccattgctgagggcatcggccctgaagaacggcgccaaaccctgttgcagaagatgagcagcttctgacttggcgtggggagctgggccccaacatggcgggtctgcagaagatcagcagcttcttacctgtgcgggagcgaaaaagctgggcttcaacatggcaggtctgtaggggtcagacccgagcagcctggactttacacctacacgaactagacactacaaaaactcatatcaaatcatggtccaaagacaatacactcccggtacaatcacgac

SEQ ID NO: 286383 - DNA, 3072 bp, Homo sapiens
  misc_feature (1050)..(1050): n is a, c, g, or t
  misc_feature (1138)..(1138): n is a, c, g, or t
  misc_feature (1321)..(1321): n is a, c, g, or t
  misc_feature (2189)..(2189): n is a, c, g, or t
atggtccttagtctcctggagtcagtgttttctctgctggtgtctggcctgtgaaaatggggaatatgagctcttgggggcatgacagactgaggaaggagtagcatctctcactcctgggaaaggggagatgactcaggaatgaggaatagggagcagtgtttgcaccctcgttttagtttctgggccaaaggaaacatacctgataaagacctacatcctttgatgtttctgagctgggggaggcaaagaatagtgacaagattctggtcttgccaaccatgaaaaggtttggggaaaccaacatttactgagcacctaattagactctgtaactggattcttactgtagctctatctcatttatccatcatagcgtcccggggagatggggtcaggagatagcagtgccaacccactagcaagggcttgactggtatatatcacatgatccccaaaggcataacatgaagtctgtattatccccacatatgcagaaggaaggcttggagaagcaatctgaccaagatcacatccctttttttttttcggagatggagggggagtctcactgtgttaccccagctagtcttgaactcctggcctcagggatccacctgcctcagccccccaagtagctgggattacaagtgctagccactgaacctggccagaatcacatcatttttaaatggctgaactaggatttaaacccatgtctgattaaacatcccaagatgttttccatggtaagtctgtgtcaatcgttagttccctgaaggaaggcttaatctagcacagtattttctgtatctactccctggtttctcccacagagctagggccatgagtaccttgtttttgactggaaggagctgtggggtggaccgtttccctgaaagctagaagaatgtttgaagcctgttcccaaggcaagtttataaagagtgaaggcagggcttgtctgattccttctgtgcccattgctctgtggctatgtgattgctctgtgcccattaccctgtggctgtgtgactgctgctgtgcccnttaccctgtggctgcgtgattgctgctgtgcccattaccctgtggctgtgtgattgctctgtgcccattatcctgtggccgtgtgatngctctgtgcccattaccctgtagccgtgtgattgctgctgtgcccattaccttgtggctgtgtgattgctgctgtgcccattatcctgtggccgtgtgattgctctgtgcccattatcctgtggccgtgtgattgctctgtgcccattatcctgtggccgtgtgattgctctgtgcccattancctgtggccgtgtgattgctgctgtgcccattaccctgtggccgtgtgattgctctgtgcccattatcctgtggccgtgtgattgctctgtgcccattatcctgtggctgtgtgattgctctgtgcccattatcctgtagccgtgtgattgcttctgtgcccattaccctgtggctgtgtgattgctgctgtgcccattatcctgtggctgtgtgattgctgctgtgcccattaccctgtggctgtgtgattgctctgtgcccattaccctgtggctgtgtgattgctctgtgcccattatcctgtggccgtgtgattgctgctgtgcctgttaccctgtggctgtgtgattgctctgtgcccattaccctgtggctatgctcccttcatctgtcatgagaagctcagctgtcatgtcctgtggtacatgctcagtggcccctgtagtttgtactgtcctcctatttctaaacccctctccccacatcctctgctggcccagcctttgctggagggtctcgcctcagcagcccagctttttcttttcacacacttttcctgaaggatctcattcaccgtcttggttccggtgatcccctctgggcagatacctctcagaatcacatttcccagcttacttccctcctgaacttccacctggcatttccgttgctggaggacatctgtaccttgatggccaaagctgaactcatctttcctcacacctgctctgattctcctccattccctgtatgtgatgtcacctggtggcctcccagttcccaggctggagagctcggaagccattctggattcctcggccaagtccttctgactccagctgtgcagtggctcttgtagtcatccnttctccccgtccgctgatgtcctttaaaacccttgtcatctcaaaccatgacagcctactaacagcagtggccatctggaaacattttcactatactgtcttatttggcttgtctgtgtgcaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcgtctgtgagccactctacgttttagccttggaaaccctcacctgctatgagactttgagcaagaccaacccttctgtcagctccttgctccagagggcacacgagcagtgcttcttaaagtccattgctgagggcatcggccctgaagaacggcgccaaaccctgttgcagaagatgagcagcttctgacttggcgtggggagctgggccccaacatggcgggtctgcagaagatcagcagcttcttacctgtgcgggagcgaaaaagctgggcttcaacatggcaggtctgtaggggtcagacccgagcagcctggactttacagttatgtgaaactgtccacaaaaagtcatggcaataatggtgtaaagaaaatagtttcttgggtatttgtaacgtacaaactatcataaaaattctcctctttcgcatctca

SEQ ID NO: 286384 - DNA, 476 bp, Homo sapiens
aaagtccaaagttatgaggtagtctctgccttcctcccagaccaggctggcagaaactctctcctcgtctcatggcagtgctgttggctgttttaattccaccccatttccttttttctttttcttttttcttgagacagactctgtcgcccaggctggagtgcagtggtgtgatctcggcttactgcaacctctgcctcccaggttaaagcgattctcctgccttggcctcctaagtagttgggactgcaggcacacgccaccacgcccagctaatttttgtatttttaatagggacagggttttaccatgttggccaggctggtctccaactcctggcctcaagtgatctacctgccttggcctcccaaagtgctgggattacaggcgtgagccactgtgcctggacgacctgagcattttcttagtccatgtttatttatgttacccacgtttcttaatcccttgactcctgt

SEQ ID NO: 286385 - DNA, 405 bp, Homo sapiens
cctcctttgttctgcattcagcagctatttatcgagtacctactctgtcaggcactgtcataggcgtggggcaaagcaggaaccaagagacgaggttccctgatctcatgggacttaggttctggtgaagggagacaatcagtgcacatgcacacaccccacacgcatacacacatgaacacatgcacatgtgcacacacaagtaagatggcttcctcccagaccaggctggcagaaactctctcctcgtctcatggcagtgctgttggctgttttaattccaccccatttccttttttctttttcttttttcttgagacagactctgtcgcccagcagagcttgcagtgagctgagatcgcgccactgcactccagcctgggtgacagagcgagactccatctc

SEQ ID NO: 286386 - DNA, 2416 bp, Homo sapiens
  misc_feature (1031)..(1031): n is a, c, g, or t
  misc_feature (1386)..(1386): n is a, c, g, or t
  misc_feature (1734)..(1734): n is a, c, g, or t
cacacacacacaccatgccccccgccaccaccaccacgcacacagacgcaggttcctggaactgtttcccccagttctctgcctcagacatcttcaccccatgtcctgccctgatctggtgttctgggcatggctccttttattgctttttaaaaggagtctgtggttttatgagggctgtttggccggcagaggttgggctaggccgggttttcgatgcctgtggccctgtcagcccagggaagaggccgctgaagctgagcagctgctcctgaaaacagcccgggacagctcttcccagcctccgcccgctgcactgagcactccactctctctgccctccggctgctagctccgatggcagcccccggcctctcagtaatcctcagcaactcaagctttcgctggagtcctcggcaggtgggcggctgtaaaatctttttgtttgctgctttgtcatcctcttcccatccccgaccggcagtacccatggtccaggaaataaacacccagtacaaaaactccctgttcgtatctggtaaattttcaactaaaaagttcagcgttcaggtgagtgggctcgagatccagccggtttgaagagagaggaataaaggacagggtgttgggcgtgggactggcacccgctgaaaccctcatcctgtgggtgcccggtgtgggtccccgctggcgtcacaacgtgcagcccacctgctctgccagcttccgcgaccttgatctcagccaatcctgttttgggccccatcacagtctttctgtctgtggagctgggcaagcaggaggtttctcagggcccaagatggtttttcagatgtgaatattggccaactcccgaagttgctagaaaaatgtaggcagcttggccaccgaagtaaaagccatcgatggcatttttcccagcctcagctgaattcaaaccactaaactcttgtggtttattttttttacagctttcttagctaacaggactggatgcctttaaaaaacttttcaaaataatattttggaanctagcattatttggttttccctctgtaaaggctaatctatcataatttccccatagcttgctttgcggaagagggtgggtgagggacaaaggaaaggtaacatgctaaccaagacaagcgtagtgtgaaggaagggcgggccctgttcggcctctgcccagcagagtcacaagctttgtgggcctcagtgtcctcctctggagaacaggaagaataatacgacagcccaactaccttacaagacagttctgtgattaggctgatgttcgtcagaacatttagtcaccgtaaaatgctacacaatgtgaattattgtgctttaacaaataatttgaaagcagtataaagtgcttcnagacttgcagatatcaagaaagctggatatctgggttattcattctcggttggcaaaaggtggtccctgcatgatcagccctacgggccccacatattcttttaagggctcaggcttttggaaggcttctcagtgcagcaagcatgaatagtaagggctacgctgcgctctttacttacttgtttttgccttaaaccatcacagttaccacaagggttaaggatgcaggtagcattgcagacagactgacagagctttgtgttctggcttggccaattagcttagcttctctgagcccagtttcctcatctgtaaaacaggtataacaacaacaacaacaacaacaanaatagtaatcagctgatacaattcttgtgagattaaaagacaacattcacaaattgcttaccagtatgatatcttgcacattgattaaatgaatgtaagataatgatgttgataattattttaaggaatttgagggagaaaattcccacctacgagttcctgtgcacctagtggtgggactttctcttggtcatgcattcatttgacaagcatttactgaataccttctgtgagctcttaggagatcagaatatgccatcctcaaatacgaaggattgttcagctgaagacgattaagaagcagatgcaggaaccctttagacttccctctatttgcctaaaagcaggacatagatttacagagacaaagagtattcctgcccaggagagcaaaggttaaccaatgaagactgctttagactctcatcagcctggaggtgatacagaggactctacttcaccagctgtctagccagcctttgtccgccatggatttgccttcccacaagttgcctgcagagacttacagtccttttcctttgtcccttctctaaaaatgtgctattctttgttgaggatcttatataagctgggagtcaaggccacttcttggagaatgattctggatacttctctgggtatctcccatgtatttataaaatacacatgttaatcaacttct

SEQ ID NO: 286387 - DNA, 4203 bp, Homo sapiens
  misc_feature (702)..(702): n is a, c, g, or t
  misc_feature (716)..(716): n is a, c, g, or t
  misc_feature (1191)..(1191): n is a, c, g, or t
  misc_feature (1235)..(1235): n is a, c, g, or t
  misc_feature (2025)..(2025): n is a, c, g, or t
  misc_feature (2685)..(2685): n is a, c, g, or t
  misc_feature (3260)..(3260): n is a, c, g, or t
  misc_feature (3377)..(3377): n is a, c, g, or t
  misc_feature (4021)..(4021): n is a, c, g, or t
  misc_feature (4142)..(4142): n is a, c, g, or t
gggttggagctggcagaaccgtaactccctctctgagggtgaatacgggccttgattgccagaagggccctcggccggggacgcgggatgatgcggggccgggagatgctttcctggaggctgagaaacctggagggagacccccaaaacttctcagttcgccgaccccttggtcccagagggagaggaggtgggctgtgcctcagcagggtcgcaggcattgcaggggcatcacgttagtcagagcatgttggcatggaggccactcagcccagggaggcaggactcacgccccaaatggaaggcacgcagtcgtgcctgcctagaggcgttaatattgtgccacactttgggggtgaggatctggcaactttatacctttttgagttgtcttttcaagtctgtaggatcagcccacagcttggttcctgtgaagtgagcttgctgtgactgcttcttcagggacaactgtggtcatcttggggagatgccttggggtctgtggcaagaggcaaaaaggagaatgtgtgatactcagaatgcattaaagcgtgctcttacagagcagaagtcagtggctgctcaccagagaggggcctgggggttgagaaaagcaaaaaaatggatgggcttctatcagatttcaacactgatgaactccagttggggggcaggtgccagccagggctattaaataataanaggaggggctgccntaggatgacaggatgggggagggtggggaggggaagaggaaggggacgtgctccaagaaggcacccagcaccagtggtctcattagctttttgctatcagtcctcaactacatttgggggacagttcctgaccaggcaatctgtcagcaaaggggtgctgcaatctgtcagcaaagggaagaggggaagtttggggtcttaactggctctctactaagatacccagaggaatgccttcatttgcataataaaccagaggaaaatttgagtctgcccctgagttccaaaggttctgggtaccagggcttgaatccagcagtgtgactattcgtgcctcagttttttcatcctgaaatttggaaagtcgttctttccattgtgatattctctagctagaacccagagaggataagaaactgcctcatggtagcctcccaggggagaaggttctagtaggagatggcctcagagcaangacttccagcctcccatcctctggtggtctgggaggatcacagnatgtcaaggccttgctcctgtggccttgattcagattagctgtggttcaagactgcctgtgtggcacatgtggatacgtgcaaggtcgctgaggcagtgctgtgcccttaaagtttatctgcttttccaacccaaaagcagactccctaaagggtagggaatgcctcattactcactgggccctcctgcagctcctggcatggaactgacacatagttggcactggcaatgcacatacttactagatgttaaagaagtccagaaccagaaccagaggcacataaataggatctgcatcagcagtgggttagagaaagggtgggaaactaagtgaaatcttagaatgcatccaaggaagtagatcaatttgagctttaactactggagaatggcccctgagaaggccccatttgttcacacgtatagctaattgtatatacctttgaggaatgcaagagccggcaggaaattcccctcctcctgaaccacagagtatttctgggtgggcatcgattgtctatgggccatggcgtaagacccccaccccccgaccccccggcaacaaaagtatcttcttgctccctaaaaaaaaatgtatggagactacatatccttgcctgtctagtcagccttggttaatttcataaagtaaaggggccctgagcctgcctgcccggccgagtttagagttgaaagggaaacgtctttgaggtggaaaccaattgcatggatcaaatggtcctgatggtgcatagagccttaggtttggaaagaagtgaagggccttgcngccttgctggggacttgagcctctcagccattggtgctctctggagctgcccgcccaccaggggcaatggcccttgttggcctccaggccccctccttccctggatgctgtgctgttctcctcttggtcttgtttcattggctgtggcagaaactttggtcccaacaaggcccaggaaacagaccctagcaaagacctgaggcaactgggtgccccaggaccacaggaactcatgtgtgctgtgagggctttaagagctttgaagtggggagtctctgacgtggatcagggctatgggtgctgatgctgtcaataagccacacgcaaaggttgggtcaatatgactgcttctcagaccctcttcggaggcagactctccctcacctgcctggccaaattccctctgggcagaaggaccctagggagcttttcctggcccatgtggcagaggcccaggctcccactcagacaatgaccccttgctttgcccactgaaagaagtccccagaagatgagctctgttacaagcagaacagaaaagaaacagtgggattagggctccaaaaaccctccagaactatcagagaattctggacagtggtccctgatggcatctgtgttaggggctgggaacaagaacccctctcacaggcacctctncaggcggggttaagactgtcaaatactggccgaggccaagggagactctgtcatgtctgaggccataggcatgttttcttctggacttcagcgagaggcagagcccccagccccatgcagtcacctcagctctgcctgagaagaagcgagggaagcccattcctccccatcagttggcctctggggaggcaaagtcaagtatgtgatggttccttacctgtgcagggaaaatggaacttgggagtcagctgtctgaaggcatcacgccttgtatgacccttgcaagcccaagctacctacctgttcctgtacagaaaccctccctggcctcatcctgtgggtggcaaacccacatattcagttattgctgttttcttccttccttggatacttgtctccaataaatatttacagtgggacccacagatgaaccttagccccaaacataagatagctatgtcaaaaggggtcctgggacagtgataccccaggggggtcaggcaaaaacagaagcaagcctcttggccacctcctcccttagccttctgcgtaaagatggacttgcaggaggagancacaccctgcaactacagaacctcatggtacggaaccaccaggggatcctcgcccacggccctgggtggaattgatgttgggaagatagattagtagtgaggcgcatcaccccactntgactcaccttcttctgcccccacgcctgtccttcagaccatctccctgctgcggcagagccactgagttcagggagcaactgtgggcagatgaaattgggctgtggtgggtgtgggaatccctgtggacttccaaaagcacttcggtttctgccctgcttggcgtggttccagaacccagggtggtggcgaggtgggagctggcagagcgcagggaagaagttccaggatcagagctcacctttctgttcttcaccctgatctgttcttccctgatcagtcctcccagactgcactggagagtgaggcctttgcctgttcggatttgctgcctcgtgtgtttcaagctgcccacacttcacaggctgcttcgaagccctccctacccaccccgtgagaaacgcccctggggagaggcagagatgggtcttttagtcttgcagcccttgtttgtttaaaatgtcaggctgacttcttctcaatcccagaaatattttactggcatggcttcagcaaacatgactcaaagcctagaaggacatggccagatctcactgagtgaccatttagtccaacctgaggactgatgttaggaggaaaaattctttctccaggtcaaattagacttctgcagatcaaatagnataccaagagaaggaggcactttggccaggatggggaggggctaaagagcaggaaacaagcttggggcgagctggaaatatgtgtaacacaggcttgtaggagcacaggcttccagtggcngggaaatctccaattgggtgtgtagtaaagacttaaacctgttaaaataaattgattagcc

SEQ ID NO: 286388 - DNA, 682 bp, Homo sapiens
agcacaatttgaaacccaacattgatttgtgtgattatttgattaatgtctccctcgcctccaagacagacctcacctaattgagctgaacatctttcccggcctctggcacttaatagcatccccaaagaacattcaagtctgagcctcaaggagcctctgcgactcggtgtctagatccaggaaatggagaatgagccgtgactttggatgcttcactcttgtccatcaggctcggaattggagctttggtatgaaccatgcccggtaacagggactgtgcagaggaagaatcccagctagcctatggatgaagagctcagtgaaaggagaggcagacaggaccgatggctgccaccttggaccatgatgtgggagccacgttatgagaatggcagagcaaccagatagcgttggcaccaccaatcccagccctggacttcccatggtaaggagagagagaaacgtcttatgggagccaccatcattctcgtgcagcaaacctgatcctaacacacagcaccaagaccctgcctcctcctctcccttccctcccagtgccgacgaagacctactatgcagagaggatagaggagggacacagaggccactggaggtgatttgaaaaggacgaggacacctgggaacaaggcaatgaaggtggctaggacagaggcatgag

SEQ ID NO: 286389 - DNA, 897 bp, Homo sapiens
gggttggagctggcagaaccgtaactccctctctgagggtgaatacgggccttgattgccagaagggccctcggccggggacgcgggatgatgcggggccgggagatgctttcctggaggctgagaaacctggagggagacccccaaaacttctcagttcgccgaccccttggtcccagagggagaggagcatccccaaagaacattcaagtctgagcctcaaggagcctctgcgactcggtgtctagatccaggaaatggagaatgagccgtgactttggatgcttcactcttgtccatcaggctcggaattggtgagcatctcccacattaccgtctccaacggaacaaggtgccccattggacatttcctctgcatggaccagccattctccaaatctgcccccatgtcaccccagctccccatcgcagtcacttctcactccttgtcccctgtccccctgagtgacaggacttttgccagttaggtcctgtccctgtttctgatcttgggtccattccccatggtccctttcttgcttgtgccttgggatctcaggcctgttgaagtaggaggcaggactcaacttcagaccagattgaagactggctgacacagaagaggcaccaaaagcacctctctctccataagacatgcccaccagtgccatgacagtttaccattgctatggcaatgcccagaagttctcaccccttttccagacatttctgcataatctacccctcaattggcatgtgatcaaaagtgggtgtcaaaatgactgtggaactgtccctgagctgctactcttgacatgctggttacagggtagcccggctctgcagggacagtcacggagctgaaaaactgctgcctaatgaagctgttttcttcta

SEQ ID NO: 286390 - DNA, 1207 bp, Homo sapiens
gggttggagctggcagaaccgtaactccctctctgagggtgaatacgggccttgattgccagaagggccctcggccggggacgcgggatgatgcggggccgggagatgctttcctggaggctgagaaacctggagggagacccccaaaacttctcagttcgccgaccccttggtcccagagggagaggagcatccccaaagaacattcaagtctgagcctcaaggagcctctgcgactcggtgtctagatccaggaaatggagaatgagccgtgactttggatgcttcactcttgtccatcaggctcggaattggtgagcatctcccacattaccgtctccaacggaacaaggtgccccattggacatttcctctgcatggaccagccattctccaaatctgcccccatgtcaccccagctccccatcgcagtcacttctcactccttgtcccctgtccccctgagtgacaggacttttgccagttaggtcctgtccctgtttctgatcttgggtccattccccatggtccctttcttgcttgtgccttgggatctcaggcctgttgaagtaggaggcaggactcaacttcagaccagattgaagactggctgacacagaagaggcaccaaaagcacctctctctccataagacatgcccaccagtgccatgacagtttaccattgctatggcaatgcccagaagttctcaccccttttccagacatttctgcataatctacccctcaattggcatgtgatcaaaagtgggtgtcaaaatgactgtggaactgtccctgagctgctactcttgacatgctggttacagggtagcccggctctgcagggacagtcacggagctgaaaaactgctgcctaatgaagctgttttcttctaccaccggctcaccctcaaattatttcctgagcgaactcaagaaccttcctgggctaagccccaattttggggctcgcctgcccctgcatcacagcttcctcttctgttcacagctgcaaccgcctactcaaccttctgcggttcctctccctgcccctccacagtggctgctgatgggagctctggctccctgcgttttcactatctcccagtcaaatgcagagtccctgtgcaatttaaatgcttctcagctaagaacagagaaggggatagcataaggatattcaaaagattcaagaaatctcaaaag

SEQ ID NO: 286391 - DNA, 485 bp, Homo sapiens
cgcccgtgacgggcatgagaaaagaaagtggtgatgccgagtgcaaaacgttagactgccccgtgtgaggctcgaactcacgaccttcagattatgagactgacgcgctgcctactgcgctaacgaggctgctcagcgaccacttcgcgccgcggcttttgtggagataggggtcgcccctcgcgcccgtgcgtcccgcttccggcgcccgaaactgtgccgcgccggccgaatacaaaccaacagactgtagccatcttctgaacgctgtcctagatcatgtgaaggcacagcttcagaggttaaaaatttcggaatctggaaaccagagagaatgtttaaccaccaggagagttccaggcgccgcggcagggggactgggagaggggactgcgcccagaatgaaggctcgggacaaaagcagttgcgcaaacgcgccaaggctggacgtcgagtgaccgcgggcggaggtcaccagcggccgc

SEQ ID NO: 286392 - DNA, 528 bp, Homo sapiens
cgcccgtgacgggcatgagaaaagaaagtggtgatgccgagtgcaaaacgttagactgccccgtgtgaggctcgaactcacgaccttcagattatgagactgacgcgctgcctactgcgctaacgaggctgctcagcgaccacttcgcgccgcggcttttgtggagataggggtcgcccctcgcgcccgtgcgtcccgcttccggcgcccgaaactgtgccgcgccggccgaatacaaaccaacagactgtagccatcttctgaacgctgtcctagatcatgtgaaggcacagcttcagaggttaaaaatttcggaatctggaaaccagagagaatgtttaagtactcttctttattaattgtatgactatcagagatgtctgagccaccaggagagttccaggcgccgcggcagggggactgggagaggggactgcgcccagaatgaaggctcgggacaaaagcagttgcgcaaacgcgccaaggctggacgtcgagtgaccgcgggcggaggtcaccagcggccgc

SEQ ID NO: 286393 - DNA, 3028 bp, Homo sapiens
ggggtaaggagttcaaggcagcgcccacacccgggggctctccgcaacccgaccgcctgtccgctcccccacttcccgccctccctcccacctactcattcacccacccacccacccagagccgggacggcagcccaggcgcccgggccccgccgtctcctcgccgcgatcctggacttcctcttgctgcaggacccggcttccacgtgtgtcccggagccggcgtctcagcacacgctccgctccgggcctgggtgcctacagcagccagagcagcagggagtccgggacccgggcggcatctgggccaagttaggcgccgccgaggccagcgctgaacgtctccagggccggaggagccgcggggcgtccgggtctgagcctcagcaaatgggctccgacgtgcgggacctgaacgcgctgctgcccgccgtcccctccctgggtggcggcggcggctgtgccctgcctgtgagcggcgcggcgcagtgggcgccggtgctggactttgcgcccccgggcgcttcggcttacgggtcgttgggcggccccgcgccgccaccggctccgccgccacccccgccgccgccgcctcactccttcatcaaacaggagccgagctggggcggcgcggagccgcacgaggagcagtgcctgagcgccttcactgtccacttttccggccagttcactggcacagccggagcctgtcgctacgggcccttcggtcctcctccgcccagccaggcgtcatccggccaggccaggatgtttcctaacgcgccctacctgcccagctgcctcgagagccagcccgctattcgcaatcagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtctggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaagaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggagtgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattcaaaaggaaaagcaa

SEQ ID NO: 286394 - DNA, 2977 bp, Homo sapiens
ggggtaaggagttcaaggcagcgcccacacccgggggctctccgcaacccgaccgcctgtccgctcccccacttcccgccctccctcccacctactcattcacccacccacccacccagagccgggacggcagcccaggcgcccgggccccgccgtctcctcgccgcgatcctggacttcctcttgctgcaggacccggcttccacgtgtgtcccggagccggcgtctcagcacacgctccgctccgggcctgggtgcctacagcagccagagcagcagggagtccgggacccgggcggcatctgggccaagttaggcgccgccgaggccagcgctgaacgtctccagggccggaggagccgcggggcgtccgggtctgagcctcagcaaatgggctccgacgtgcgggacctgaacgcgctgctgcccgccgtcccctccctgggtggcggcggcggctgtgccctgcctgtgagcggcgcggcgcagtgggcgccggtgctggactttgcgcccccgggcgcttcggcttacgggtcgttgggcggccccgcgccgccaccggctccgccgccacccccgccgccgccgcctcactccttcatcaaacaggagccgagctggggcggcgcggagccgcacgaggagcagtgcctgagcgccttcactgtccacttttccggccagttcactggcacagccggagcctgtcgctacgggcccttcggtcctcctccgcccagccaggcgtcatccggccaggccaggatgtttcctaacgcgccctacctgcccagctgcctcgagagccagcccgctattcgcaatcagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtctggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaagaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggagtgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattcaaaaggaaaagcaa

SEQ ID NO: 286395 - DNA, 2488 bp, Homo sapiens
tccgcaggcgctttcaccactgcccctcccggggggacctgaaggagagggtttgaggccggtctttgcccgccgaggtctgcgtgtccggtctgggaggaggcctaggagggctcgcgggccacggcatccttgggcccgagttctggggtgcggacggacgtctcgagagtgggtgccgcgactcgggacccacggccctcgccgggcacggacagttgcggagcagggctctgaggattgtgcagtgccctgggtccctgcctactcctgggctcaggaatggagaagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtctggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaagaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggagtgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattcaaaaggaaaagcaa

SEQ ID NO: 286396 - DNA, 1804 bp, Homo sapiens
atgggccatcatcatcatcatcatcatcatcatcacagcagcggccatatcgaaggtcgtgatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtctggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaagaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggagtgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattcaaaaggaaaagcaa

SEQ ID NO: 286397 - DNA, 2452 bp, Homo sapiens
tccgcaggcgctttcaccactgcccctcccggggggacctgaaggagagggtttgaggccggtctttgcccgccgaggtctgcgtgtccggtctgggaggaggcctaggagggctcgcgggccacggcatccttgggcccgagttctggggtgcggacggacgtctcgccgggcacggacagttgcggagcagggctctgaggattgtgcagtgccctgggtccctgcctactcctgggctcaggaatggagaagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtctggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaagaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggagtgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattcaaaaggaaaagcaa

SEQ ID NO: 286398 - DNA, 354 bp, Homo sapiens
aatggcagagctagatgtgagccttggggcagaatcctctggcccctgagctcccattcatttgtaacttgcaagttggggatcatcctaccctaacaagctccagcgaagtgccttaggcattttgggatctgttcagtcctagtaggagaggttgcctttaatgagatccccttttccagtatcattttcaaatagaatatgtgtcttccccaaggtgagaaaccataccagtgtgacttcaaggactgtgaacgaaggttttctcgttcagaccagctcaaaagacaccaaaggagacatacaggtttgtaggttcacttctcattgctggcagctgtgttcccttgggct

SEQ ID NO: 286399 - DNA, 461 bp, Homo sapiens
ccttagattattcttggattttctacaatcacaatgcacttcctgccgtgcttgtgttgggaaatctgccagaacccacaggagggaaagtctaatgaaagcacgcgcctgctggaaaacgaaccgggcttttgaaaagagaggggctgcgtttgtgctgacacgagcaagagacctgtattgccttaacactcccagcaatgaccacctgcaagcttgcgctgcgactcccgtccgaagacatgcgggccagtatgagcggagaggttcccagcaccgtcacaagaccctgtgctattattttagactcacctgtggctgttgacaacaccacacacatgaaatgatgctcaccagaatcaaaatactcagctaaacaaagaattgtgttggtcatgaaattattaccaggagggataaaactccagggtgagccattaaagaatctgaattcaattcat

SEQ ID NO: 286400 - DNA, 378 bp, Homo sapiens
ccttagattattcttggattttctacaatcacaatgcacttcctgccgtgcttgtgttgggaaatctgccagaacccacaggagggaaagtctaatgaaagcacgcgcctgctggaaaacgaaccgggcttttgaaaagagaggggctgcgtttgtgctgacacgagcaagagacctgtattgccttaacactcccagcaatgaccacctgcaagcttgcgctgcgactcccgtccgaagacatgcgggccagtatgagcggagaggttcccagcaccgtcacaagaccctgtgctattattttagactcacctgtggctgttgacaacaccacacacatgaaatgatgctcaccagaatcaaaatactcagctaaac

SEQ ID NO: 286401 - DNA, 668 bp, Homo sapiens
agcaacagcagctccaaggtaagtgaagcaaaccattagttacaatgtatttactttttaaaaaagtctccgtggtgaaaacaaaatgtccttttgcttaatattagtgttctaagaacccagtgttgtcaggactttgaaaagtgcttgatgttttaattatattttttattgttgttaaagtagatgtcttgctgggttcagtggttcacgcctataatcatagccctttgggagtccaagacaggaggattgcttgaggacaggaggtcaacacaagctttggcaacgtagtgagacctcctctctataaaataaaaataaaaaattgctgagcatggtggcacacacctgtagtcctaactactgaggaagctaaggcaggagagtcacttgagcttaggagttggaggttgtagtgagctaagattgcaccactatactccagcctaggtgacagactgagaccttatctccaaaaaaaaaaaaaaaaaaaaaaaaaaaaatatgtatgaggagaaaaggaacaaaaaaaataataaaaaacaaagagtggaggaaagaggaaacaagataggaaagagaaaaagaaaaaaaaaggaaacacaagagaaaacaaggaagaaaaaaaagagaaagaaatacacaaaaaaaaacaacagaacagg

SEQ ID NO: 286402 - DNA, 481 bp, Homo sapiens
atacagtgagtgctgccaacatctggcatactagaattgatctactgggcactgcagcctagtggctaaaagtcctgccacttactaaccatgggaccttggacatgttcttcaactgctgtgtgttatgaggattaaatgatttaatccataaaaaatgcttgaagaatgccaacatgcacaatgttgctccaacagccaagttatgatcttggaagagtttgctgtccagtgacttcctgatggcattcaaggttggcatagaacgctacctggcccatgggttactcgccatctaaaaccaaaaatcaggacatatttatatcttattgctatgtccaaaggttgatttttcttcacttggtgagcatcttctgtttggcatttccacatgtaataagttaagaactgatttgagaagatatccaaaaaatgcaattgtataaatccaaataaaaaatttaaataatcatcccaaaaa

SEQ ID NO: 286403 - DNA, 693 bp, Homo sapiens
atacagtgagtgctgccaacatctggcatactagaattgatctactgggcactgcagcctagtggctaaaagtcctgccacttactaaccatgggaccttggacatgttcttcaactgctgtgtgttatgaggattaaatgatttaatccataaaaaatgcttgaagaatgccaacatgcacaatgttgctccaacagccaagttatgatcttggaagagtttgctgtccagtgacttcctgatggcattcaaggttggcatagaacgctacctggcccatgggttactcgccatctaaaaccaaaaatcaggacatatttatatcttattgctatgtccaaaggttgatttttcttcacttgcctctcttgaaggtagttgtggcaataaagtgtagtctccatgaaagggatgtgagcagaagtcatgtgtgccacttctggttcatcaactcaaaggcaaaggtactttttgaggacttccagcaccctcttccaacagactggaagatggatgtggatatgaaacgacttcaaccacacagaccaggacatcagtctaggggctggcagaggtgagcatcttctgtttggcatttccacatgtaataagttaagaactgatttgagaagatatccaaaaaatgcaattgtataaatccaaataaaaaatttaaataatcatcccaaaaa

SEQ ID NO: 286404 - DNA, 2019 bp, Homo sapiens
cgccctgcgcgctcgggctggctcggcggctgcggcgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtca

SEQ ID NO: 286405 - DNA, 737 bp, Homo sapiens
  misc_feature (554)..(554): n is a, c, g, or t
  misc_feature (558)..(558): n is a, c, g, or t
  misc_feature (562)..(562): n is a, c, g, or t
tggcacgagggagcatttagccttctggaagaacccctgcctggggtgggactgtgcacgccagacaaggtggcatgggcctgaacccacctggactgacttctgcactgaagccacaaatggagggtaggctggtgggtgggggagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgangganaggnggttcctccaaaacccgcctttggacttggtttcctgtcaaaggggctctaaaagggcccagggtttaaaaccccaaccccccttttgaatatgaatagggacagggggaaaaggattttctgtggccccaacatgtttgccccccgccaaaaaaaagccccctttttgggtggg

SEQ ID NO: 286406 - DNA, 793 bp, Homo sapiens
cgccctgcgcgctcgggctggctcggcggctgcggcgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgatggagtctcactctgtcacccaggctggagtgcagtggcacaatctcgactcactgcaagctcctcctcccgggttcatgccattctcctgcctcagcctcccgagtagctggactacaggcgcctgccaccacgctcggctaattttttgtatttttagtagagatgaggtttcaccatcttggccaggctggtcttgaactcctgacctcgtgatccacccgcctcggcctcccaaagtgctgggattacaggcatagccactgtgcctggcctc

SEQ ID NO: 286407 - DNA, 3081 bp, Homo sapiens
  misc_feature (2854)..(2854): n is a, c, g, or t
  misc_feature (2892)..(2892): n is a, c, g, or t
cgccctgcgcgctcgggctggctcggcggctgcggcgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtcacctgggctcctgtcagggcctggccctgagggtggtaaagggaaaggtagactcaccctctgccccactcttccacagagtgagcaggggccctgtggctgccccggcccccagctctctagttgggaagaagtgcagccctccctgtcttctgcggggcctgtgcctctcagagggcagtgctgttcctggacatgaagccgcacaaggaacgttttattcctaagaaaaagtttcctaaatttggattgtggagcggactgtagaatgcgtctgacagttcagttcaagcacaagaagtgggtagcggtcagtgctgtctgcaggtcgggcgtttcacccagcatgtgcccccgtgccatgggttctcatgccgtcctcagtgtccacatttcacagatgagatcagcaagacagtcagctcctcaagggaccacagttggcaagtggccaagcagggactgaagcccaggcagcctgattctagaaaccctaagtgatgtctgtgttttagatggcccctagcaggacctagcattctgacttcagtcctgagaaggccaacagccagtaggccccactgttggggcttctgaagaggggatcgggggatgacgggggcacggggctataaataggaaggcacagagcttcaagaaaggctcacccagggatgagctcagcccactgggccaatgaaagcctggccagggctggtgttgggcccggagcagcatcttccggtgctatcctcccctcccacccctcacagctcaagccaagtccagcggccgcagtcttcacctctccacactcactttttatctggtgtttntacttctgcctgcgtttgctctctagccaataaaccgnccttgtgtgcgacagaaaaaaaaagcaaaaaaaaatgggccacactgacaaacaagaaacctccagggggggcccggtccccaattggccctttgggggggccgtttacaattaaaatggcggcggttttaaaccgccgtaactggaaaaaccctggctttccccaacttattcgcctggcagaacatc

SEQ ID NO: 286408 - DNA, 1968 bp, Homo sapiens
cgccctgcgcgctcgggctggctcggcggctgcggcgggcgggcaggcgggcaggccggcaggcgggtgcgcggagggctggtgccccgcagcaggtgggcggggtgcggttggcggcggcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtca

SEQ ID NO: 286409 - DNA, 3851 bp, Homo sapiens
  misc_feature (3624)..(3624): n is a, c, g, or t
  misc_feature (3662)..(3662): n is a, c, g, or t
tcgacttcgaggaggagtcaccccagcagcaggccccacgtcaagcccagcacacactcagtcacatcacacacatctcaccactgtcccacaccactgcctctgactgcacaggagctagaagccagcttgggtaaggcgggggcactgccatgtgatcaggtcagtcctgagacactggggagggcagcagcccccacctctgtccacagcctgccccggtgccctgtggccatggagctggacttgtttccctctgcaaaacgctggagctggcggcagggccagccacactgagtagtgtggagaactcagggcggcagctgtcccatccccagggcccctccacctcctgctgtctctgaatgccaggccctggggaggccctgaggatagaggaggaggcctggccgtgcctttctggagttcacagacccctaaagacaggaggcagggatggcgtcgtaggcctggagagcgcctggggggcgggagggcctgaggctgtgcttaaggcccagaggtcctggagcagggcatgtcttgtcctgaggcttaggcagggcccccaggggagttggggcaggaggtggggaggacaggatcgtggaggcttcgcatgtcatggtgtctgttggtttttaggctttcttgggaagtctggtgtttcctatgtagtttggggactaggccacacctctccctcatgcttgtcaccactgctacaccttgtctgcccactttctctccttcccgcccctggaggtgagaccctcacctctctcgtgagcatgctgcctcatgtcttccgtgccgtcgttctgtggctgggtgactgtccctcaggccgccaaccctagttggctctcacagcaacttccagtgctcctggacggggacttcctaagcagcatgggggccacacgggccggccacgcacactggcctgggtccgcattccctatttcaggctgttgtctcgggtcagatctccggaagcggcaggagcgctgggtctcctggtcgtggccgggcagcgtctttcttcttcagggtctggatgccacttcccgcctcctccctgtgcccagtggaaggagaaacatcctagagggtggagactgccctgtttttcttttgccattgagtcccagtgtgactcaagcacgaggccacctttctctgccagaggacagaaagcttcagtgactggcccagggtcacacagttctgccgcccagcccagcagcctgagccagcagtcaggatggggtggggacactccgtctctcttgagaccccactcagagaatggggctgacactgtaggagaaatataagcaggactcctgctggctgctcccctcctgcatgaggcatgttagagggactgggaccgccagcccccagctcccatgccgggcctcggcccagtctcagctcctgtttgggagggggggcagaggggcaggggggcagaagttgagtctgggagctggggcagggcacaggctctagggtccagctgtcctcctctcccctcccctgctggccactcctgctgccgtctccacactctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtcacctgggctcctgtcagggcctggccctgagggtggtaaagggaaaggtagactcaccctctgccccactcttccacagagtgagcaggggccctgtggctgccccggcccccagctctctagttgggaagaagtgcagccctccctgtcttctgcggggcctgtgcctctcagagggcagtgctgttcctggacatgaagccgcacaaggaacgttttattcctaagaaaaagtttcctaaatttggattgtggagcggactgtagaatgcgtctgacagttcagttcaagcacaagaagtgggtagcggtcagtgctgtctgcaggtcgggcgtttcacccagcatgtgcccccgtgccatgggttctcatgccgtcctcagtgtccacatttcacagatgagatcagcaagacagtcagctcctcaagggaccacagttggcaagtggccaagcagggactgaagcccaggcagcctgattctagaaaccctaagtgatgtctgtgttttagatggcccctagcaggacctagcattctgacttcagtcctgagaaggccaacagccagtaggccccactgttggggcttctgaagaggggatcgggggatgacgggggcacggggctataaataggaaggcacagagcttcaagaaaggctcacccagggatgagctcagcccactgggccaatgaaagcctggccagggctggtgttgggcccggagcagcatcttccggtgctatcctcccctcccacccctcacagctcaagccaagtccagcggccgcagtcttcacctctccacactcactttttatctggtgtttntacttctgcctgcgtttgctctctagccaataaaccgnccttgtgtgcgacagaaaaaaaaagcaaaaaaaaatgggccacactgacaaacaagaaacctccagggggggcccggtccccaattggccctttgggggggccgtttacaattaaaatggcggcggttttaaaccgccgtaactggaaaaaccctggctttccccaacttattcgcctggcagaacatc

SEQ ID NO: 286410 - DNA, 2144 bp, Homo sapiens
cgccctgcgcgctcgggctggctcggcggctgcggcgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgacaggatcttgctgtgtcacccagactggagtgcagtggtgcaatcatagcttactactatagcctcaaactcctgggttcaaatgatccttccgcctgggcctcccagagtattgggattacagggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtca

SEQ ID NO: 286411 - DNA, 1748 bp, Homo sapiens
cgccctgcgcgctcgggctggctcggcggctgcggcgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtca

SEQ ID NO: 286412 - DNA, 1956 bp, Homo sapiens
cgccctgcgcgctcgggctggctcggcggctgcggcgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtca

SEQ ID NO: 286413 - DNA, 2419 bp, Homo sapiens
cgccctgcgcgctcgggctggctcggcggctgcggcgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcaggcggggccagcactgctgaacccactggggccccctggctcccataccctgtccgtgggcagcatgagctcctctgggcaagtcctatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgaggtgggcccggtgccgcaaggtggggcaggaatgggctgggtgaggagcagcctgggcactgggatcaggcacatggggcctggaggggccctgttggcaaagtggggaccagcaggttaaagagggcatatccagctctgaggaaaggatccttgctctgctgggtctctggagcaagtgagatgagcgccagccactgaaggtgtagcacatgccacgggccatggggaggtggcagctctgtccccacttagtcctggggccagttccacccttggccaggccatgaccgtcctctactgccatctctgcagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtca

SEQ ID NO: 286414 - DNA, 2755 bp, Homo sapiens
tcgacttcgaggaggagtcaccccagcagcaggccccacgtcaagcccagcacacactcagtcacatcacacacatctcaccactgtcccacaccactgcctctgactgcacaggagctagaagccagcttgggtaaggcgggggcactgccatgtgatcaggtcagtcctgagacactggggagggcagcagcccccacctctgtccacagcctgccccggtgccctgtggccatggagctggacttgtttccctctgcaaaacgctggagctggcggcagggccagccacactgagtagtgtggagaactcagggcggcagctgtcccatccccagggcccctccacctcctgctgtctctgaatgccaggccctggggaggccctgaggatagaggaggaggcctggccgtgcctttctggagttcacagacccctaaagacaggaggcagggatggcgtcgtaggcctggagagcgcctggggggcgggagggcctgaggctgtgcttaaggcccagaggtcctggagcagggcatgtcttgtcctgaggcttaggcagggcccccaggggagttggggcaggaggtggggaggacaggatcgtggaggcttcgcatgtcatggtgtctgttggtttttaggctttcttgggaagtctggtgtttcctatgtagtttggggactaggccacacctctccctcatgcttgtcaccactgctacaccttgtctgcccactttctctccttcccgcccctggaggtgagaccctcacctctctcgtgagcatgctgcctcatgtcttccgtgccgtcgttctgtggctgggtgactgtccctcaggccgccaaccctagttggctctcacagcaacttccagtgctcctggacggggacttcctaagcagcatgggggccacacgggccggccacgcacactggcctgggtccgcattccctatttcaggctgttgtctcgggtcagatctccggaagcggcaggagcgctgggtctcctggtcgtggccgggcagcgtctttcttcttcagggtctggatgccacttcccgcctcctccctgtgcccagtggaaggagaaacatcctagagggtggagactgccctgtttttcttttgccattgagtcccagtgtgactcaagcacgaggccacctttctctgccagaggacagaaagcttcagtgactggcccagggtcacacagttctgccgcccagcccagcagcctgagccagcagtcaggatggggtggggacactccgtctctcttgagaccccactcagagaatggggctgacactgtaggagaaatataagcaggactcctgctggctgctcccctcctgcatgaggcatgttagagggactgggaccgccagcccccagctcccatgccgggcctcggcccagtctcagctcctgtttgggagggggggcagaggggcaggcacaggctctagggtccagctgtcctcctctcccctcccctgctggccactcctgctgccgtctccacactctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtca

SEQ ID NO: 286415 - DNA, 1330 bp, Homo sapiens
cttcttcacccgggcggtgcagttcacggaggagaaatttggccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtca

SEQ ID NO: 286416 - DNA, 1614 bp, Homo sapiens
gattagatctagaggatcccgacgctctctctgtggggtctgatctgtttctcactctgccccacacccactggggaggggttactgctttccctccctgggcctcagtttcccctctgtggggaaatgttttctccacagtaccctgtagcacacagtaggccctcaggatgcacttgctgggtggatttctccgatgggtgatggaggaagggtctgtcactgcagctgcctgtggggtcctgagtggggctctagcttctctggggttggggctccaggtgtgaagtcaggcatagacccagaaggctctctgtgttcccaggggaaagggacaggcggctcccaggtaggctccaggagaagactgcggggaagctggtgggtggtgtgtgggtgctcatggctgccctgccctgcccaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtca

SEQ ID NO: 286417 - DNA, 1603 bp, Homo sapiens
  misc_feature (6)..(6): n is a, c, g, or t
tgaatnacaggccggcggctgccgggagtctagacaggagccgaaacctcgaagaggcggcggccacggagcagggaggagggtgtgatcaagtggactccagccccgttcctagataccgtgttaacgctaagaaactgacccctctcctgcccccgccacttactgacatggactcaaccttggattcgtcaacaggctcccttctgaaaaccaataatcatattggcggtggggccttcagtgtggactccccacagagagaggacgctctctctgtggggcagaggcagtacctgggcaagctggcggctggggtcccaacaactgccaggagcacggctctgtccccagcctgggaaagcccctgcccctcctctccctcatcaaggacacgggcctgtccacaggctgccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtca

SEQ ID NO: 286418 - DNA, 1373 bp, Homo sapiens
gattagatctagaggatcccgacgctctctctgtggggtctgatctgtttctcactctgccccacacccactggggaggggttactgctttccctccctgggcctcagtttcccctctgtggggaaatgttttctccacagtaccctgtagcacacagtaggccctcaggatgcacttgctgggtggatttctccgatgggtgatggaggaagggtctgtcactgcagctgcctgtggggtcctgagtggggctctagcttctctggggttggggctccaggtgtgaagtcaggcatagacccagaaggctctctgtgttcccaggggaaagggacaggcggctcccaggtaggctccaggagaagactgcggggaagctggtgggtggtgtgtgggtgctcatggctgccctgccctgcccaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtca

SEQ ID NO: 286419 - DNA, 692 bp, Homo sapiens
cacgaggcagtgctagggggaggggtggagccattcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtca

SEQ ID NO: 286420 - DNA, 2548 bp, Homo sapiens
  misc_feature (2321)..(2321): n is a, c, g, or t
  misc_feature (2359)..(2359): n is a, c, g, or t
cgccctgcgcgctcgggctggctcggcggctgcggcgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctagctcaagccaagtccagcggccgcagtcttcacctctccacactcactttttatctggtgtttttacttctgcctgcgtttgctctctagccaataaaccgtccttgtgtgcgagtcacctgggctcctgtcagggcctggccctgagggtggtaaagggaaaggtagactcaccctctgccccactcttccacagagtgagcaggggccctgtggctgccccggcccccagctctctagttgggaagaagtgcagccctccctgtcttctgcggggcctgtgcctctcagagggcagtgctgttcctggacatgaagccgcacaaggaacgttttattcctaagaaaaagtttcctaaatttggattgtggagcggactgtagaatgcgtctgacagttcagttcaagcacaagaagtgggtagcggtcagtgctgtctgcaggtcgggcgtttcacccagcatgtgcccccgtgccatgggttctcatgccgtcctcagtgtccacatttcacagatgagatcagcaagacagtcagctcctcaagggaccacagttggcaagtggccaagcagggactgaagcccaggcagcctgattctagaaaccctaagtgatgtctgtgttttagatggcccctagcaggacctagcattctgacttcagtcctgagaaggccaacagccagtaggccccactgttggggcttctgaagaggggatcgggggatgacgggggcacggggctataaataggaaggcacagagcttcaagaaaggctcacccagggatgagctcagcccactgggccaatgaaagcctggccagggctggtgttgggcccggagcagcatcttccggtgctatcctcccctcccacccctcacagctcaagccaagtccagcggccgcagtcttcacctctccacactcactttttatctggtgtttntacttctgcctgcgtttgctctctagccaataaaccgnccttgtgtgcgacagaaaaaaaaagcaaaaaaaaatgggccacactgacaaacaagaaacctccagggggggcccggtccccaattggccctttgggggggccgtttacaattaaaatggcggcggttttaaaccgccgtaactggaaaaaccctggctttccccaacttattcgcctggcagaacatc

SEQ ID NO: 286421 - DNA, 2951 bp, Homo sapiens
  misc_feature (2724)..(2724): n is a, c, g, or t
  misc_feature (2762)..(2762): n is a, c, g, or t
cgccctgcgcgctcgggctggctcggcggctgcggcgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtcacctgggctcctgtcagggcctggccctgagggtggtaaagggaaaggtagactcaccctctgccccactcttccacagagtgagcaggggccctgtggctgccccggcccccagctctctagttgggaagaagtgcagccctccctgtcttctgcggggcctgtgcctctcagagggcagtgctgttcctggacatgaagccgcacaaggaacgttttattcctaagaaaaagtttcctaaatttggattgtggagcggactgtagaatgcgtctgacagttcagttcaagcacaagaagtgggtagcggtcagtgctgtctgcaggtcgggcgtttcacccagcatgtgcccccgtgccatgggttctcatgccgtcctcagtgtccacatttcacagatgagatcagcaagacagtcagctcctcaagggaccacagttggcaagtggccaagcagggactgaagcccaggcagcctgattctagaaaccctaagtgatgtctgtgttttagatggcccctagcaggacctagcattctgacttcagtcctgagaaggccaacagccagtaggccccactgttggggcttctgaagaggggatcgggggatgacgggggcacggggctataaataggaaggcacagagcttcaagaaaggctcacccagggatgagctcagcccactgggccaatgaaagcctggccagggctggtgttgggcccggagcagcatcttccggtgctatcctcccctcccacccctcacagctcaagccaagtccagcggccgcagtcttcacctctccacactcactttttatctggtgtttntacttctgcctgcgtttgctctctagccaataaaccgnccttgtgtgcgacagaaaaaaaaagcaaaaaaaaatgggccacactgacaaacaagaaacctccagggggggcccggtccccaattggccctttgggggggccgtttacaattaaaatggcggcggttttaaaccgccgtaactggaaaaaccctggctttccccaacttattcgcctggcagaacatc

SEQ ID NO: 286422 - DNA, 2866 bp, Homo sapiens
  misc_feature (2639)..(2639): n is a, c, g, or t
  misc_feature (2677)..(2677): n is a, c, g, or t
cgccctgcgcgctcgggctggctcggcggctgcggcgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtcacctgggctcctgtcagggcctggccctgagggtggtaaagggaaaggtagactcaccctctgccccactcttccacagagtgagcaggggccctgtggctgccccggcccccagctctctagttgggaagaagtgcagccctccctgtcttctgcggggcctgtgcctctcagagggcagtgctgttcctggacatgaagccgcacaaggaacgttttattcctaagaaaaagtttcctaaatttggattgtggagcggactgtagaatgcgtctgacagttcagttcaagcacaagaagtgggtagcggtcagtgctgtctgcaggtcgggcgtttcacccagcatgtgcccccgtgccatgggttctcatgccgtcctcagtgtccacatttcacagatgagatcagcaagacagtcagctcctcaagggaccacagttggcaagtggccaagcagggactgaagcccaggcagcctgattctagaaaccctaagtgatgtctgtgttttagatggcccctagcaggacctagcattctgacttcagtcctgagaaggccaacagccagtaggccccactgttggggcttctgaagaggggatcgggggatgacgggggcacggggctataaataggaaggcacagagcttcaagaaaggctcacccagggatgagctcagcccactgggccaatgaaagcctggccagggctggtgttgggcccggagcagcatcttccggtgctatcctcccctcccacccctcacagctcaagccaagtccagcggccgcagtcttcacctctccacactcactttttatctggtgtttntacttctgcctgcgtttgctctctagccaataaaccgnccttgtgtgcgacagaaaaaaaaagcaaaaaaaaatgggccacactgacaaacaagaaacctccagggggggcccggtccccaattggccctttgggggggccgtttacaattaaaatggcggcggttttaaaccgccgtaactggaaaaaccctggctttccccaacttattcgcctggcagaacatc

SEQ ID NO: 286423 - DNA, 1623 bp, Homo sapiens
cgccctgcgcgctcgggctggctcggcggctgcggcgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctcggggatgcaggcaggggcaggggctccagagccacaggtcaggtcgaccggcc

SEQ ID NO: 286424 - DNA, 1599 bp, Homo sapiens
cgccctgcgcgctcgggctggctcggcggctgcggcgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctcgggctagtcgggtaaggtcctgctagagt

SEQ ID NO: 286425 - DNA, 1659 bp, Homo sapiens
  misc_feature (1432)..(1432): n is a, c, g, or t
  misc_feature (1470)..(1470): n is a, c, g, or t
cgccctgcgcgctcgggctggctcggcggctgcggcgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctagctcaagccaagtccagcggccgcagtcttcacctctccacactcactttttatctggtgtttntacttctgcctgcgtttgctctctagccaataaaccgnccttgtgtgcgacagaaaaaaaaagcaaaaaaaaatgggccacactgacaaacaagaaacctccagggggggcccggtccccaattggccctttgggggggccgtttacaattaaaatggcggcggttttaaaccgccgtaactggaaaaaccctggctttccccaacttattcgcctggcagaacatc

SEQ ID NO: 286426 - DNA, 1486 bp, Homo sapiens
cgccctgcgcgctcgggctggctcggcggctgcggcgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctagctcaagccaagtccagcggccgcagtcttcacctctccacactcactttttatctggtgtttttacttctgcctgcgtttgctctctagccaataaaccgtccttgtgtgcgagtca

SEQ ID NO: 286427 - DNA, 1506 bp, Homo sapiens
cgccctgcgcgctcgggctggctcggcggctgcggcgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctagctcaagccaagtccagcggccgcagtcttcacctctccacactcactttttatctggtgtttttacttctgcctgcgtttgctctctagccaataaaccgtccttgtgtgcgagtcaaaaaaaaaaagtcgtatcga

SEQ ID NO: 286428 - DNA, 2231 bp, Homo sapiens
  misc_feature (2004)..(2004): n is a, c, g, or t
  misc_feature (2042)..(2042): n is a, c, g, or t
cgccctgcgcgctcgggctggctcggcggctgcggcgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgtggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtcacctgggctcctgtcagggcctggccctgagggtggtaaagggaaaggtagactcaccctctgccccactcttccacagagtgagcaggggccctgtggctgccccggcccccagctctctagttgggaagaagtgcagccctccctgtcttctgcggggcctgtgcctctcagagggcagtgctgttcctggacatgaagccgcacaaggaacgttttattcctaagaaaaagtttcctaaatttggattgtggagcggactgtagaatgcgtctgacagttcagttcaagcacaagaagtgggtagcggtcagtgctgtctgcaggtcgggcgtttcacccagcatgtgcccccgtgccatgggttctcatgccgtcctcagtgtccacatttcacagatgagatcagcaagacagtcagctcctcaagggaccacagttggcaagtggccaagcagggactgaagcccaggcagcctgattctagaaaccctaagtgatgtctgtgttttagatggcccctagcaggacctagcattctgacttcagtcctgagaaggccaacagccagtaggccccactgttggggcttctgaagaggggatcgggggatgacgggggcacggggctataaataggaaggcacagagcttcaagaaaggctcacccagggatgagctcagcccactgggccaatgaaagcctggccagggctggtgttgggcccggagcagcatcttccggtgctatcctcccctcccacccctcacagctcaagccaagtccagcggccgcagtcttcacctctccacactcactttttatctggtgtttntacttctgcctgcgtttgctctctagccaataaaccgnccttgtgtgcgacagaaaaaaaaagcaaaaaaaaatgggccacactgacaaacaagaaacctccagggggggcccggtccccaattggccctttgggggggccgtttacaattaaaatggcggcggttttaaaccgccgtaactggaaaaaccctggctttccccaacttattcgcctggcagaacatc

SEQ ID NO: 286429 - DNA, 1015 bp, Homo sapiens
cgccctgcgcgctcgggctggctcggcggctgcggcgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacgacggtgcctgactttcaggagactagacctcgtaattacattctctcggccagcgcctccgcgttctcacctcacacaccagagccctctacactctcaaacaccagagccccatacacacacacacaccagatcccccctacacacacatcagagcccaacacacacacaccagagccccctacacacacaccagagcccccaacacacacaccagagcccccaacacacacacaccagagcctccaacacatacacaccagaggcacttca

SEQ ID NO: 286430 - DNA, 834 bp, Homo sapiens
  misc_feature (651)..(651): n is a, c, g, or t
  misc_feature (655)..(655): n is a, c, g, or t
  misc_feature (659)..(659): n is a, c, g, or t
cgccctgcgcgctcgggctggctcggcggctgcggcgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgangganaggnggttcctccaaaacccgcctttggacttggtttcctgtcaaaggggctctaaaagggcccagggtttaaaaccccaaccccccttttgaatatgaatagggacagggggaaaaggattttctgtggccccaacatgtttgccccccgccaaaaaaaagccccctttttgggtggg

SEQ ID NO: 286431 - DNA, 780 bp, Homo sapiens
cgccctgcgcgctcgggctggctcggcggctgcggcgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgacaggatcttgctgtgtcacccagactggagtgcagtggtgcaatcatagcttactactatagcctcaaactcctgggttcaaatgatccttccgcctgggcctcccagagtattgggattacaggtgtgagccagcgcgcccagcctcttattgtttcttcacatattttttctgccttattttctcctcctcttctgggactcttgttagtcatatgttggttcacttgacagtgccccgtaggtgctgaggcgctgctcatt

SEQ ID NO: 286432 - DNA, 766 bp, Homo sapiens
  misc_feature (539)..(539): n is a, c, g, or t
  misc_feature (577)..(577): n is a, c, g, or t
tgggccaatgaaagcagggtcaaggacaggaccagcgcaggccaaggaagggaatatctgacagcgcccacccagccaaaccctcagtgtccacatttcacagatgagatcagcaagacagtcagctcctcaagggaccacagttggcaagtggccaagcagggactgaagcccaggcagcctgattctagaaaccctaagtgatgtctgtgttttagatggcccctagcaggacctagcattctgacttcagtcctgagaaggccaacagccagtaggccccactgttggggcttctgaagaggggatcgggggatgacgggggcacggggctataaataggaaggcacagagcttcaagaaaggctcacccagggatgagctcagcccactgggccaatgaaagcctggccagggctggtgttgggcccggagcagcatcttccggtgctatcctcccctcccacccctcacagctcaagccaagtccagcggccgcagtcttcacctctccacactcactttttatctggtgtttntacttctgcctgcgtttgctctctagccaataaaccgnccttgtgtgcgacagaaaaaaaaagcaaaaaaaaatgggccacactgacaaacaagaaacctccagggggggcccggtccccaattggccctttgggggggccgtttacaattaaaatggcggcggttttaaaccgccgtaactggaaaaaccctggctttccccaacttattcgcctggcagaacatc

SEQ ID NO: 286433 - DNA, 204 bp, Homo sapiens
agcgcaccccacccccaccccacccctcgtcctcctctctccccacgtcccacaccactgcctctgactgcacaggagctagaagccagcttgggtaaggcgggggcactgccatgtgatcaggtcagtcctgagacactggggagggcagcagcccccacctctgtccacagcctgccccggtgccctgtggccatggagctg

SEQ ID NO: 286434 - DNA, 390 bp, Homo sapiens
ccgcccagcccagcagcctgagccagcagtcaggatggggtggggacactccgtctctcttgagaccccactcagagaatggggctgacactgtaggagaaatataagcaggactcctgctggctgctcccctcctgcatgaggcatgttagagggactgggaccgccagcccccagctcccatgccgggcctcggcccagtctcagctcctgtttgggagggggggcagaggggcaggggggcagaagttgagtctgggagctggggcagggcacaggctctagggtccagctgtcctcctctcccctcccctgctggccactcctgctgccgtctccacactctggaatgatgaagtggacaaggtaagttggggcctggggggctgg

SEQ ID NO: 286435 - DNA, 4542 bp, Homo sapiens
ctttccgacactctttgggaagagaatctctaatgacggcaacagtggagaacctaacgttccagaaggacactttgggaaatgctgttgacaaaaacaggcgccacggctcgacagagccactcgtcctcgcctggtcatcccagttccggaggctgacctggggatgcgccctggacgccctgcaccgcagtccttgcgtcgctgctagtcagcacggcgttacccacctcatccgcagctccaggacgccgcactccacgcgctgccgcaaggaggacgcgcagcctggtcaccatggaaacggtgccgcctccgtcacggctcaagcgagaggtcaaaggtcagtcctgcaagttccgcttccggttccgagatcctgtttgttttctgaaagctttgtggtttcggtgagctctcagagccgatttctagcgtccgtgccggggacaggtgtccagaggtcgactgctgcagacatggcggcctccaccgcggccgggaagcagcggattcccaaagtggccaaggtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaagacttttgaagataatataagaaaaaacaggactgtgattagtaactggataaaatacgcacaatgggaagaaagcctaaaggagattcaaagggctcgatccatatacgagcgtgctttagatgtagactaccgaaatattacactctggctgaaatacgcagaaatggaaatgaagaatcgccaagtcaaccatgctcgaaatatctgggaccgggccataacaacgctgcctcgagttaatcagttctggtacaagtacacgtacatggaggaaatgttgggaaacgttgccggtgcccggcaggtgtttgagcgctggatggagtggcagcctgaggagcaagcctggcactcctacatcaactttgagctgagatacaaagaggtggatcgggcccgcaccatttatgagcgatttgtcctcgtgcaccctgatgttaagaactggatcaagtatgcccgctttgaagaaaaacatgcttattttgcccatgcacggaaagtgtatgagagagctgtggaattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctgagaggacaagacaggtgtatcaagcctctttggaactaattcctcacaaaaagttcacatttgccaaaatgtggatactgtatgcacagtttgaaatacgacagaagaatctgtcattagccagaagagcattgggaacttccataggcaaatgtccaaagaacaaattatttaaagtttacatagaattggagctacagcttcgagaatttgacagatgccggaagctttatgaaaagttcctggaatttggacctgaaaattgtacctcatggattaaattcgctgaattagagacaatccttggtgatattgacagagcacgggcaatctatgaattagccatcagtcagccacgtttagacatgccagaggtgctttggaaatcatatattgattttgaaattgagcaggaagaaacagaaagaacacgaaacctttaccggcggttgcttcaacggacgcagcatgtcaaggtatggatcagctttgctcagtttgagttgtcttcaggaaaagaaggaagtttgactaaatgcagacaaatttatgaagaagctaacaaaaccatgcgaaactgtgaagaaaaggaagagagacttatgctgctggaatcttggcgaagttttgaagaagaatttggaacagcttcagataaggagagagtagacaaactcatgccagagaaagtcaagaagagaagaaaggtccagactgatgatgggtctgatgcaggctgggaagaatactttgattacatctttccagaagatgctgccaaccaacctaacctcaaactcctggccatggccaaactgtggaagaaacagcagcaggaaaaggaggatgctgagcaccatccagatgaggacgtcgatgagagtgaatcctgatctttttttcatagacaaatgttttgttatttttataaattaattgtttggaactcttgtgactcctggaagttcttatatatttcaccagtaagaaattgattggtatctttgatggctactttttaagttattttttaaatgctcttgggttagctaggggtagggattgcaagtaaaggacttttttaactgctggatttgtttttccaactgagtccaaacttttctaatgtctgtccacatcatgcattaggaaatgtaattaaggtaacattctacagttacttttcatgtcatacccataaagatagtttatgcattcatctgaaatgtgtaactttttcatgtcttcagagtcacagacttgagttcatttcccagctctgccactcatgattatataacttaattttcattttcctcattcacaaaatgggccaatagtttgacagctcattttgaagattacattataaaaggaatatacctggtgggtgcatagtaagtgctcagtaaattgtttgttctaagccacttttaaaaatggtttcattccttgtagaattgaatgcgagtggattaataatttaccttactttcttactagtgtccagttatattgttttttagaacaacacttggaaaataatttgcagtgattatatttctgaacaaggttcagaaaacattgtttactaagaatttagtctaataatttcagttaggcgctcatcagttctccagagtggttgagtttgtaataccttgtttaaagaataatggcttgttcacgtgtgtgctatgaaaaatgatgtcccatgttcacataaatttgggaaattctggactaagacttaagtctcgttaatcaaatctctttatagttaggcttctgtacattatgtatctccagtagcaatgttgccatattatttatttcccaaacttagtggacaatggagtcatttctacctagagtaccagtaaacatctcccagtgtgctatagtagaaaatgtctactcctcactgctgacatgttaaacttactcttggtttagagcatgtgtagaaacacctaaggtagctctatgctaaataatgaagagtagcacaagaatgaatgtatttgctgatacgttgctcacattctcaagcaaaaattcaactgcattaaccgatctgagagttttcctttaacctggactgtgtttctcaagcacattttttctttgttcactgcccaaggactagaactgtatttttaaggttgttttcccctaaaaggacctttagtaagcaaatttattattaaatgtgcacatcttattcacccaagggaataaaagctacttcgtaatgttgttactaaattttatcttgaaaataaataacagtgtttgaggacagaagaaactaggactgttgttgagataaaatctgttttcagcctgactgctttagtcactggacgagcatcagctactgcggtgtcagatcacttctcgagtagaggtctgcctagtgagtgagcaggagaacatcatcttaatagcctttggctcacccagagtcagggagagatgaaaataataggtcagaatgcaagtgacttaatcacagtcttcctagaattatctgtttgtttatgttgcatgaatgcataagaaaaaaattctgtcatgttcccaaggtagaattgtaataagcatgtgccagtgtgaaagctggaaggaaaaaagctattctctaacaggagaacataaagattcatttctctcccaccctcaactccaccaaagtaaatcctttcgatagtaaaagtttaataatttcttgtgggtttttctttcgttaagtctttcactaactaactaactggatattttcacatattacagaggaagacactacacataaaatacatggttggcctatgatatagttatatggcctttctttaggaattatgttcttttccctctccaaaaaaaaaa

SEQ ID NO: 286436 - DNA, 3954 bp, Homo sapiens
ctttccgacactctttgggaagagaatctctaatgacggcaacagtggagaacctaacgttccagaaggacactttgggaaatgctgttgacaaaaacaggcgccacggctcgacagagccactcgtcctcgcctggtcatcccagttccggaggctgacctggggatgcgccctggacgccctgcaccgcagtccttgcgtcgctgctagtcagcacggcgttacccacctcatccgcagctccaggacgccgcactccacgcgctgccgcaaggaggacgcgcagcctggtcaccatggaaacggtgccgcctccgtcacggctcaagcgagaggtcaaaggtcagtcctgcaagttccgcttccggttccgagatcctgtttgttttctgaaagctttgtggtttcggtgagctctcagagccgatttctagcgtccgtgccggggacaggtgtccagaggtcgactgctgcagacatggcggcctccaccgcggccgggaagcagcggattcccaaagtggccaaggtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaagacttttgaagataatataagaaaaaacaggactgtgattagtaactggataaaatacgcacaatgggaagaaagcctaaaggagattcaaagggctcgatccatatacgagcgtgctttagatgtagactaccgaaatattacactctggctgaaatacgcagaaatggaaatgaagaatcgccaagtcaaccatgctcgaaatatctgggaccgggccataacaacgctgcctcgagttaatcagttctggtacaagtacacgtacatggaggaaatgttgggaaacgttgccggtgcccggcaggtgtttgagcgctggatggagtggcagcctgaggagcaagcctggcactcctacatcaactttgagctgagatacaaagaggtggatcgggcccgcaccatttatgagcgatttgtcctcgtgcaccctgatgttaagaactggatcaagtatgcccgctttgaagaaaaacatgcttattttgcccatgcacggaaagtgtatgagagagctgtggaattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctgagaggacaagacaggtgtatcaagcctctttggaactaattcctcacaaaaagttcacatttgccaaaatgtggatactgtatgcacagtttgaaatacgacagaagaatctgtcattagccagaagagcattgggaacttccataggcaaatgtccaaagaacaaattatttaaagtttacatagaattggagctacagcttcgagaatttgacagatgccggaagctttatgaaaagttcctggaatttggacctgaaaattgtacctcatggattaaattcgctgaattagagacaatccttggtgatattgacagagcacgggcaatctatgaattagccatcagtcagccacgtttagacatgccagaggtgctttggaaatcatatattgattttgaaattgagcaggaagaaacagaaagaacacgaaacctttaccggcggttgcttcaacggacgcagcatgtcaaggtatggatcagctttgctcagtttgagttgtcttcaggaaaagaaggaagtttgactaaatgcagacaaatttatgaagaagctaacaaaaccatgcgaaactgtgaagaaaaggaagagagacttatgctgctggaatcttggcgaagttttgaagaagaatttggaacagcttcagataaggagagagtagacaaactcatgccagagaaagtcaagaagagaagaaaggtccagactgatgatgggtctgatgcaggctgggaagaatactttgattacatctttccagaagatgctgccaaccaacctaacctcaaactcctggccatggccaaactgtggaagaaacagcagcaggaaaaggaggatgctgagcaccatccagatgaggacgtcgatgagagtgaatcctgatctttttttcatagacaaatgttttgttatttttataaattaattgtttggaactcttgtgactcctggaagttcttatatatttcaccagtaagaaattgattggtatctttgatggctactttttaagttattttttaaatgctcttgggttagctaggggtagggattgcaagtaaaggacttttttaactgctggatttgtttttccaactgagtccaaacttttctaatgtctgtccacatcatgcattaggaaatgtaattaaggtaacattctacagttacttttcatgtcatacccataaagatagtttatgcattcatctgaaatgtgtaactttttcatgtcttcagagtcacagacttgagttcatttcccagctctgccactcatgattatataacttaattttcattttcctcattcacaaaatgggccaatagtttgacagctcattttgaagattacattataaaaggaatatacctggtgggtgcatagtaagtgctcagtaaattgtttgttctaagccacttttaaaaatggtttcattccttgtagaattgaatgcgagtggattaataatttaccttactttcttactagtgtccagttatattgttttttagaacaacacttggaaaataatttgcagtgattatatttctgaacaaggttcagaaaacattgtttactaagaatttagtctaataatttcagttaggcgctcatcagttctccagagtggttgagtttgtaataccttgtttaaagaataatggcttgttcacgtgtgtgctatgaaaaatgatgtcccatgttcacataaatttgggaaattctggactaagacttaagtctcgttaatcaaatctctttatagttaggcttctgtacattatgtatctccagtagcaatgttgccatattatttatttcccaaacttagtggacaatggagtcatttctacctagagtaccagtaaacatctcccagtgtgctatagtagaaaatgtctactcctcactgctgacatgttaaacttactcttggtttagagcatgtgtagaaacacctaaggtagctctatgctaaataatgaagagtagcacaagaatgaatgtatttgctgatacgttgctcacattctcaagcaaaaattcaactgcattaaccgatctgagagttttcctttaacctggactgtgtttctcaagcacattttttctttgttcactgcccaaggactagaactgtatttttaaggttgttttcccctaaaaggacctttagtaagcaaatttattattaaatgtgcacatcttattcacccaagggaataaaagctacttcgtaatgttgttactaaattttatcttgaaaataaataacagtgtttgaggaca

SEQ ID NO: 286437 - DNA, 4578 bp, Homo sapiens
  misc_feature (122)..(122): n is a, c, g, or t
  misc_feature (135)..(135): n is a, c, g, or t
ctttccgacactctttgggaagagaatctctaatgacggcaacagtggagaacctaacgttccagaaggacactttgggaaatgctgttgacaaaaacacatccagattggagctccgttcntactcccttgcanggcgccacggctcgacagagccactcgtcctcgcctggtcatcccagttccggaggctgacctggggatgcgccctggacgccctgcaccgcagtccttgcgtcgctgctagtcagcacggcgttacccacctcatccgcagctccaggacgccgcactccacgcgctgccgcaaggaggacgcgcagcctggtcaccatggaaacggtgccgcctccgtcacggctcaagcgagaggtcaaaggtcagtcctgcaagttccgcttccggttccgagatcctgtttgttttctgaaagctttgtggtttcggtgagctctcagagccgatttctagcgtccgtgccggggacaggtgtccagaggtcgactgctgcagacatggcggcctccaccgcggccgggaagcagcggattcccaaagtggccaaggtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaagacttttgaagataatataagaaaaaacaggactgtgattagtaactggataaaatacgcacaatgggaagaaagcctaaaggagattcaaagggctcgatccatatacgagcgtgctttagatgtagactaccgaaatattacactctggctgaaatacgcagaaatggaaatgaagaatcgccaagtcaaccatgctcgaaatatctgggaccgggccataacaacgctgcctcgagttaatcagttctggtacaagtacacgtacatggaggaaatgttgggaaacgttgccggtgcccggcaggtgtttgagcgctggatggagtggcagcctgaggagcaagcctggcactcctacatcaactttgagctgagatacaaagaggtggatcgggcccgcaccatttatgagcgatttgtcctcgtgcaccctgatgttaagaactggatcaagtatgcccgctttgaagaaaaacatgcttattttgcccatgcacggaaagtgtatgagagagctgtggaattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctgagaggacaagacaggtgtatcaagcctctttggaactaattcctcacaaaaagttcacatttgccaaaatgtggatactgtatgcacagtttgaaatacgacagaagaatctgtcattagccagaagagcattgggaacttccataggcaaatgtccaaagaacaaattatttaaagtttacatagaattggagctacagcttcgagaatttgacagatgccggaagctttatgaaaagttcctggaatttggacctgaaaattgtacctcatggattaaattcgctgaattagagacaatccttggtgatattgacagagcacgggcaatctatgaattagccatcagtcagccacgtttagacatgccagaggtgctttggaaatcatatattgattttgaaattgagcaggaagaaacagaaagaacacgaaacctttaccggcggttgcttcaacggacgcagcatgtcaaggtatggatcagctttgctcagtttgagttgtcttcaggaaaagaaggaagtttgactaaatgcagacaaatttatgaagaagctaacaaaaccatgcgaaactgtgaagaaaaggaagagagacttatgctgctggaatcttggcgaagttttgaagaagaatttggaacagcttcagataaggagagagtagacaaactcatgccagagaaagtcaagaagagaagaaaggtccagactgatgatgggtctgatgcaggctgggaagaatactttgattacatctttccagaagatgctgccaaccaacctaacctcaaactcctggccatggccaaactgtggaagaaacagcagcaggaaaaggaggatgctgagcaccatccagatgaggacgtcgatgagagtgaatcctgatctttttttcatagacaaatgttttgttatttttataaattaattgtttggaactcttgtgactcctggaagttcttatatatttcaccagtaagaaattgattggtatctttgatggctactttttaagttattttttaaatgctcttgggttagctaggggtagggattgcaagtaaaggacttttttaactgctggatttgtttttccaactgagtccaaacttttctaatgtctgtccacatcatgcattaggaaatgtaattaaggtaacattctacagttacttttcatgtcatacccataaagatagtttatgcattcatctgaaatgtgtaactttttcatgtcttcagagtcacagacttgagttcatttcccagctctgccactcatgattatataacttaattttcattttcctcattcacaaaatgggccaatagtttgacagctcattttgaagattacattataaaaggaatatacctggtgggtgcatagtaagtgctcagtaaattgtttgttctaagccacttttaaaaatggtttcattccttgtagaattgaatgcgagtggattaataatttaccttactttcttactagtgtccagttatattgttttttagaacaacacttggaaaataatttgcagtgattatatttctgaacaaggttcagaaaacattgtttactaagaatttagtctaataatttcagttaggcgctcatcagttctccagagtggttgagtttgtaataccttgtttaaagaataatggcttgttcacgtgtgtgctatgaaaaatgatgtcccatgttcacataaatttgggaaattctggactaagacttaagtctcgttaatcaaatctctttatagttaggcttctgtacattatgtatctccagtagcaatgttgccatattatttatttcccaaacttagtggacaatggagtcatttctacctagagtaccagtaaacatctcccagtgtgctatagtagaaaatgtctactcctcactgctgacatgttaaacttactcttggtttagagcatgtgtagaaacacctaaggtagctctatgctaaataatgaagagtagcacaagaatgaatgtatttgctgatacgttgctcacattctcaagcaaaaattcaactgcattaaccgatctgagagttttcctttaacctggactgtgtttctcaagcacattttttctttgttcactgcccaaggactagaactgtatttttaaggttgttttcccctaaaaggacctttagtaagcaaatttattattaaatgtgcacatcttattcacccaagggaataaaagctacttcgtaatgttgttactaaattttatcttgaaaataaataacagtgtttgaggacagaagaaactaggactgttgttgagataaaatctgttttcagcctgactgctttagtcactggacgagcatcagctactgcggtgtcagatcacttctcgagtagaggtctgcctagtgagtgagcaggagaacatcatcttaatagcctttggctcacccagagtcagggagagatgaaaataataggtcagaatgcaagtgacttaatcacagtcttcctagaattatctgtttgtttatgttgcatgaatgcataagaaaaaaattctgtcatgttcccaaggtagaattgtaataagcatgtgccagtgtgaaagctggaaggaaaaaagctattctctaacaggagaacataaagattcatttctctcccaccctcaactccaccaaagtaaatcctttcgatagtaaaagtttaataatttcttgtgggtttttctttcgttaagtctttcactaactaactaactggatattttcacatattacagaggaagacactacacataaaatacatggttggcctatgatatagttatatggcctttctttaggaattatgttcttttccctctccaaaaaaaaaa

SEQ ID NO: 286438 - DNA, 4357 bp, Homo sapiens
ctttccgacactctttgggaagagaatctctaatgacggcaacagtggagaacctaacgttccagaaggacactttgggaaatgctgttgacaaaaacaggcgccacggctcgacagagccactcgtcctcgcctggtcatcccagttccggaggctgacctggggatgcgccctggacgccctgcaccgcagtccttgcgtcgctgctagtcagcacggcgttacccacctcatccgcagctccaggacgccgcactccacgcgctgccgcaaggaggacgcgcagcctggtcaccatggaaacggtgccgcctccgtcacggctcaagcgagaggtcaaaggtgtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaagacttttgaagataatataagaaaaaacaggactgtgattagtaactggataaaatacgcacaatgggaagaaagcctaaaggagattcaaagggctcgatccatatacgagcgtgctttagatgtagactaccgaaatattacactctggctgaaatacgcagaaatggaaatgaagaatcgccaagtcaaccatgctcgaaatatctgggaccgggccataacaacgctgcctcgagttaatcagttctggtacaagtacacgtacatggaggaaatgttgggaaacgttgccggtgcccggcaggtgtttgagcgctggatggagtggcagcctgaggagcaagcctggcactcctacatcaactttgagctgagatacaaagaggtggatcgggcccgcaccatttatgagcgatttgtcctcgtgcaccctgatgttaagaactggatcaagtatgcccgctttgaagaaaaacatgcttattttgcccatgcacggaaagtgtatgagagagctgtggaattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctgagaggacaagacaggtgtatcaagcctctttggaactaattcctcacaaaaagttcacatttgccaaaatgtggatactgtatgcacagtttgaaatacgacagaagaatctgtcattagccagaagagcattgggaacttccataggcaaatgtccaaagaacaaattatttaaagtttacatagaattggagctacagcttcgagaatttgacagatgccggaagctttatgaaaagttcctggaatttggacctgaaaattgtacctcatggattaaattcgctgaattagagacaatccttggtgatattgacagagcacgggcaatctatgaattagccatcagtcagccacgtttagacatgccagaggtgctttggaaatcatatattgattttgaaattgagcaggaagaaacagaaagaacacgaaacctttaccggcggttgcttcaacggacgcagcatgtcaaggtatggatcagctttgctcagtttgagttgtcttcaggaaaagaaggaagtttgactaaatgcagacaaatttatgaagaagctaacaaaaccatgcgaaactgtgaagaaaaggaagagagacttatgctgctggaatcttggcgaagttttgaagaagaatttggaacagcttcagataaggagagagtagacaaactcatgccagagaaagtcaagaagagaagaaaggtccagactgatgatgggtctgatgcaggctgggaagaatactttgattacatctttccagaagatgctgccaaccaacctaacctcaaactcctggccatggccaaactgtggaagaaacagcagcaggaaaaggaggatgctgagcaccatccagatgaggacgtcgatgagagtgaatcctgatctttttttcatagacaaatgttttgttatttttataaattaattgtttggaactcttgtgactcctggaagttcttatatatttcaccagtaagaaattgattggtatctttgatggctactttttaagttattttttaaatgctcttgggttagctaggggtagggattgcaagtaaaggacttttttaactgctggatttgtttttccaactgagtccaaacttttctaatgtctgtccacatcatgcattaggaaatgtaattaaggtaacattctacagttacttttcatgtcatacccataaagatagtttatgcattcatctgaaatgtgtaactttttcatgtcttcagagtcacagacttgagttcatttcccagctctgccactcatgattatataacttaattttcattttcctcattcacaaaatgggccaatagtttgacagctcattttgaagattacattataaaaggaatatacctggtgggtgcatagtaagtgctcagtaaattgtttgttctaagccacttttaaaaatggtttcattccttgtagaattgaatgcgagtggattaataatttaccttactttcttactagtgtccagttatattgttttttagaacaacacttggaaaataatttgcagtgattatatttctgaacaaggttcagaaaacattgtttactaagaatttagtctaataatttcagttaggcgctcatcagttctccagagtggttgagtttgtaataccttgtttaaagaataatggcttgttcacgtgtgtgctatgaaaaatgatgtcccatgttcacataaatttgggaaattctggactaagacttaagtctcgttaatcaaatctctttatagttaggcttctgtacattatgtatctccagtagcaatgttgccatattatttatttcccaaacttagtggacaatggagtcatttctacctagagtaccagtaaacatctcccagtgtgctatagtagaaaatgtctactcctcactgctgacatgttaaacttactcttggtttagagcatgtgtagaaacacctaaggtagctctatgctaaataatgaagagtagcacaagaatgaatgtatttgctgatacgttgctcacattctcaagcaaaaattcaactgcattaaccgatctgagagttttcctttaacctggactgtgtttctcaagcacattttttctttgttcactgcccaaggactagaactgtatttttaaggttgttttcccctaaaaggacctttagtaagcaaatttattattaaatgtgcacatcttattcacccaagggaataaaagctacttcgtaatgttgttactaaattttatcttgaaaataaataacagtgtttgaggacagaagaaactaggactgttgttgagataaaatctgttttcagcctgactgctttagtcactggacgagcatcagctactgcggtgtcagatcacttctcgagtagaggtctgcctagtgagtgagcaggagaacatcatcttaatagcctttggctcacccagagtcagggagagatgaaaataataggtcagaatgcaagtgacttaatcacagtcttcctagaattatctgtttgtttatgttgcatgaatgcataagaaaaaaattctgtcatgttcccaaggtagaattgtaataagcatgtgccagtgtgaaagctggaaggaaaaaagctattctctaacaggagaacataaagattcatttctctcccaccctcaactccaccaaagtaaatcctttcgatagtaaaagtttaataatttcttgtgggtttttctttcgttaagtctttcactaactaactaactggatattttcacatattacagaggaagacactacacataaaatacatggttggcctatgatatagttatatggcctttctttaggaattatgttcttttccctctccaaaaaaaaaa

SEQ ID NO: 286439 - DNA, 4263 bp, Homo sapiens
ctttccgacactctttgggaagagaatctctaatgacggcaacagtggagaacctaacgttccagaaggacactttgggaaatgctgttgacaaaaacatccttgcgtcgctgctagtcagcacggcgttacccacctcatccgcagctccaggacgccgcactccacgcgctgccgcaaggaggacgcgcagcctggtcaccatggaaacggtgccgcctccgtcacggctcaagcgagaggtcaaaggtgtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaagacttttgaagataatataagaaaaaacaggactgtgattagtaactggataaaatacgcacaatgggaagaaagcctaaaggagattcaaagggctcgatccatatacgagcgtgctttagatgtagactaccgaaatattacactctggctgaaatacgcagaaatggaaatgaagaatcgccaagtcaaccatgctcgaaatatctgggaccgggccataacaacgctgcctcgagttaatcagttctggtacaagtacacgtacatggaggaaatgttgggaaacgttgccggtgcccggcaggtgtttgagcgctggatggagtggcagcctgaggagcaagcctggcactcctacatcaactttgagctgagatacaaagaggtggatcgggcccgcaccatttatgagcgatttgtcctcgtgcaccctgatgttaagaactggatcaagtatgcccgctttgaagaaaaacatgcttattttgcccatgcacggaaagtgtatgagagagctgtggaattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctgagaggacaagacaggtgtatcaagcctctttggaactaattcctcacaaaaagttcacatttgccaaaatgtggatactgtatgcacagtttgaaatacgacagaagaatctgtcattagccagaagagcattgggaacttccataggcaaatgtccaaagaacaaattatttaaagtttacatagaattggagctacagcttcgagaatttgacagatgccggaagctttatgaaaagttcctggaatttggacctgaaaattgtacctcatggattaaattcgctgaattagagacaatccttggtgatattgacagagcacgggcaatctatgaattagccatcagtcagccacgtttagacatgccagaggtgctttggaaatcatatattgattttgaaattgagcaggaagaaacagaaagaacacgaaacctttaccggcggttgcttcaacggacgcagcatgtcaaggtatggatcagctttgctcagtttgagttgtcttcaggaaaagaaggaagtttgactaaatgcagacaaatttatgaagaagctaacaaaaccatgcgaaactgtgaagaaaaggaagagagacttatgctgctggaatcttggcgaagttttgaagaagaatttggaacagcttcagataaggagagagtagacaaactcatgccagagaaagtcaagaagagaagaaaggtccagactgatgatgggtctgatgcaggctgggaagaatactttgattacatctttccagaagatgctgccaaccaacctaacctcaaactcctggccatggccaaactgtggaagaaacagcagcaggaaaaggaggatgctgagcaccatccagatgaggacgtcgatgagagtgaatcctgatctttttttcatagacaaatgttttgttatttttataaattaattgtttggaactcttgtgactcctggaagttcttatatatttcaccagtaagaaattgattggtatctttgatggctactttttaagttattttttaaatgctcttgggttagctaggggtagggattgcaagtaaaggacttttttaactgctggatttgtttttccaactgagtccaaacttttctaatgtctgtccacatcatgcattaggaaatgtaattaaggtaacattctacagttacttttcatgtcatacccataaagatagtttatgcattcatctgaaatgtgtaactttttcatgtcttcagagtcacagacttgagttcatttcccagctctgccactcatgattatataacttaattttcattttcctcattcacaaaatgggccaatagtttgacagctcattttgaagattacattataaaaggaatatacctggtgggtgcatagtaagtgctcagtaaattgtttgttctaagccacttttaaaaatggtttcattccttgtagaattgaatgcgagtggattaataatttaccttactttcttactagtgtccagttatattgttttttagaacaacacttggaaaataatttgcagtgattatatttctgaacaaggttcagaaaacattgtttactaagaatttagtctaataatttcagttaggcgctcatcagttctccagagtggttgagtttgtaataccttgtttaaagaataatggcttgttcacgtgtgtgctatgaaaaatgatgtcccatgttcacataaatttgggaaattctggactaagacttaagtctcgttaatcaaatctctttatagttaggcttctgtacattatgtatctccagtagcaatgttgccatattatttatttcccaaacttagtggacaatggagtcatttctacctagagtaccagtaaacatctcccagtgtgctatagtagaaaatgtctactcctcactgctgacatgttaaacttactcttggtttagagcatgtgtagaaacacctaaggtagctctatgctaaataatgaagagtagcacaagaatgaatgtatttgctgatacgttgctcacattctcaagcaaaaattcaactgcattaaccgatctgagagttttcctttaacctggactgtgtttctcaagcacattttttctttgttcactgcccaaggactagaactgtatttttaaggttgttttcccctaaaaggacctttagtaagcaaatttattattaaatgtgcacatcttattcacccaagggaataaaagctacttcgtaatgttgttactaaattttatcttgaaaataaataacagtgtttgaggacagaagaaactaggactgttgttgagataaaatctgttttcagcctgactgctttagtcactggacgagcatcagctactgcggtgtcagatcacttctcgagtagaggtctgcctagtgagtgagcaggagaacatcatcttaatagcctttggctcacccagagtcagggagagatgaaaataataggtcagaatgcaagtgacttaatcacagtcttcctagaattatctgtttgtttatgttgcatgaatgcataagaaaaaaattctgtcatgttcccaaggtagaattgtaataagcatgtgccagtgtgaaagctggaaggaaaaaagctattctctaacaggagaacataaagattcatttctctcccaccctcaactccaccaaagtaaatcctttcgatagtaaaagtttaataatttcttgtgggtttttctttcgttaagtctttcactaactaactaactggatattttcacatattacagaggaagacactacacataaaatacatggttggcctatgatatagttatatggcctttctttaggaattatgttcttttccctctccaaaaaaaaaa

SEQ ID NO: 286440 - DNA, 4362 bp, Homo sapiens
agctgttccaaggattcaagctttggtcagtttgagcttgtcttcagagaaaagaaggaagtttgactaaatgcagacaaatttatgaagaagctaacaaaaccatgcgaaactgtgaagaagaggaagagagacttatgctgctggaatcttggcgaagttttgaagaagaatttggaacagcttcagataaggagagagtagacaaactcatgccagagaaagtcaagaagagaagaaaggtccagaccgatgatgggtctgatgcaggctgggaagaatactttgattacatctttccagaagatgctgccaaccaacctaacctcaaactcctggccatggccaaggtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaagacttttgaagataatataagaaaaaacaggactgtgattagtaactggataaaatacgcacaatgggaagaaagcctaaaggagattcaaagggctcgatccatatacgagcgtgctttagatgtagactaccgaaatattacactctggctgaaatacgcagaaatggaaatgaagaatcgccaagtcaaccatgctcgaaatatctgggaccgggccataacaacgctgcctcgagttaatcagttctggtacaagtacacgtacatggaggaaatgttgggaaacgttgccggtgcccggcaggtgtttgagcgctggatggagtggcagcctgaggagcaagcctggcactcctacatcaactttgagctgagatacaaagaggtggatcgggcccgcaccatttatgagcgatttgtcctcgtgcaccctgatgttaagaactggatcaagtatgcccgctttgaagaaaaacatgcttattttgcccatgcacggaaagtgtatgagagagctgtggaattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctgagaggacaagacaggtgtatcaagcctctttggaactaattcctcacaaaaagttcacatttgccaaaatgtggatactgtatgcacagtttgaaatacgacagaagaatctgtcattagccagaagagcattgggaacttccataggcaaatgtccaaagaacaaattatttaaagtttacatagaattggagctacagcttcgagaatttgacagatgccggaagctttatgaaaagttcctggaatttggacctgaaaattgtacctcatggattaaattcgctgaattagagacaatccttggtgatattgacagagcacgggcaatctatgaattagccatcagtcagccacgtttagacatgccagaggtgctttggaaatcatatattgattttgaaattgagcaggaagaaacagaaagaacacgaaacctttaccggcggttgcttcaacggacgcagcatgtcaaggtatggatcagctttgctcagtttgagttgtcttcaggaaaagaaggaagtttgactaaatgcagacaaatttatgaagaagctaacaaaaccatgcgaaactgtgaagaaaaggaagagagacttatgctgctggaatcttggcgaagttttgaagaagaatttggaacagcttcagataaggagagagtagacaaactcatgccagagaaagtcaagaagagaagaaaggtccagactgatgatgggtctgatgcaggctgggaagaatactttgattacatctttccagaagatgctgccaaccaacctaacctcaaactcctggccatggccaaactgtggaagaaacagcagcaggaaaaggaggatgctgagcaccatccagatgaggacgtcgatgagagtgaatcctgatctttttttcatagacaaatgttttgttatttttataaattaattgtttggaactcttgtgactcctggaagttcttatatatttcaccagtaagaaattgattggtatctttgatggctactttttaagttattttttaaatgctcttgggttagctaggggtagggattgcaagtaaaggacttttttaactgctggatttgtttttccaactgagtccaaacttttctaatgtctgtccacatcatgcattaggaaatgtaattaaggtaacattctacagttacttttcatgtcatacccataaagatagtttatgcattcatctgaaatgtgtaactttttcatgtcttcagagtcacagacttgagttcatttcccagctctgccactcatgattatataacttaattttcattttcctcattcacaaaatgggccaatagtttgacagctcattttgaagattacattataaaaggaatatacctggtgggtgcatagtaagtgctcagtaaattgtttgttctaagccacttttaaaaatggtttcattccttgtagaattgaatgcgagtggattaataatttaccttactttcttactagtgtccagttatattgttttttagaacaacacttggaaaataatttgcagtgattatatttctgaacaaggttcagaaaacattgtttactaagaatttagtctaataatttcagttaggcgctcatcagttctccagagtggttgagtttgtaataccttgtttaaagaataatggcttgttcacgtgtgtgctatgaaaaatgatgtcccatgttcacataaatttgggaaattctggactaagacttaagtctcgttaatcaaatctctttatagttaggcttctgtacattatgtatctccagtagcaatgttgccatattatttatttcccaaacttagtggacaatggagtcatttctacctagagtaccagtaaacatctcccagtgtgctatagtagaaaatgtctactcctcactgctgacatgttaaacttactcttggtttagagcatgtgtagaaacacctaaggtagctctatgctaaataatgaagagtagcacaagaatgaatgtatttgctgatacgttgctcacattctcaagcaaaaattcaactgcattaaccgatctgagagttttcctttaacctggactgtgtttctcaagcacattttttctttgttcactgcccaaggactagaactgtatttttaaggttgttttcccctaaaaggacctttagtaagcaaatttattattaaatgtgcacatcttattcacccaagggaataaaagctacttcgtaatgttgttactaaattttatcttgaaaataaataacagtgtttgaggacagaagaaactaggactgttgttgagataaaatctgttttcagcctgactgctttagtcactggacgagcatcagctactgcggtgtcagatcacttctcgagtagaggtctgcctagtgagtgagcaggagaacatcatcttaatagcctttggctcacccagagtcagggagagatgaaaataataggtcagaatgcaagtgacttaatcacagtcttcctagaattatctgtttgtttatgttgcatgaatgcataagaaaaaaattctgtcatgttcccaaggtagaattgtaataagcatgtgccagtgtgaaagctggaaggaaaaaagctattctctaacaggagaacataaagattcatttctctcccaccctcaactccaccaaagtaaatcctttcgatagtaaaagtttaataatttcttgtgggtttttctttcgttaagtctttcactaactaactaactggatattttcacatattacagaggaagacactacacataaaatacatggttggcctatgatatagttatatggcctttctttaggaattatgttcttttccctctccaaaaaaaaaa

SEQ ID NO: 286441 - DNA, 3392 bp, Homo sapiens
ctttccgacactctttgggaagagaatctctaatgacggcaacagtggagaacctaacgttccagaaggacactttgggaaatgctgttgacaaaaacaggcgccacggctcgacagagccactcgtcctcgcctggtcatcccagttccggaggctgacctggggatgcgccctggacgccctgcaccgcagtccttgcgtcgctgctagtcagcacggcgttacccacctcatccgcagctccaggacgccgcactccacgcgctgccgcaaggaggacgcgcagcctggtcaccatggaaacggtgccgcctccgtcacggctcaagcgagaggtcaaaggtcagtcctgcaagttccgcttccggttccgagatcctgtttgttttctgaaagctttgtggtttcggtgagctctcagagccgatttctagcgtccgtgccggggacaggtgtccagaggtcgactgctgcagacatggcggcctccaccgcggccgggaagcagcggattcccaaagtggccaaggtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaagacttttgaagataatataagaaaaaacaggactgtgattagtaactggataaaatacgcacaatgggaagaaagcctaaaggagattcaaagggctcgatccatatacgagcgtgctttagatgtagactaccgaaatattacactctggctgaaatacgcagaaatggaaatgaagaatcgccaagtcaaccatgctcgaaatatctgggaccgggccataacaacgctgcctcgagttaatcagttctggtacaagtacacgtacatggaggaaatgttgggaaacgttgccggtgcccggcaggtgtttgagcgctggatggagtggcagcctgaggagcaagcctggcactcctacatcaactttgagctgagatacaaagaggtggatcgggcccgcaccatttatgagcgatttgtcctcgtgcaccctgatgttaagaactggatcaagtatgcccgctttgaagaaaaacatgcttattttgcccatgcacggaaagtgtatgagagagctgtggaattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctgagaggacaagacaggtgtatcaagcctctttggaactaattcctcacaaaaagttcacatttgccaaaatgtggatactgtatgcacagtttgaaatacgacagaagaatctgtcattagccagaagagcattgggaacttccataggcaaatgtccaaagaacaaattatttaaagtttacatagaattggagctacagcttcgagaatttgacagatgccggaagctttatgaaaagttcctggaatttggacctgaaaattgtacctcatggattaaattcgctgaattagagacaatccttggtgatattgacagagcacgggcaatctatgaattagccatcagtcagccacgtttagacatgccagaggtgctttggaaatcatatattgattttgaaattgagcaggaagaaacagaaagaacacgaaacctttaccggcggttgcttcaacggacgcagcatgtcaaggtatggatcagctttgctcagtttgagttgtcttcaggaaaagaaggaagtttgactaaatgcagacaaatttatgaagaagctaacaaaaccatgcgaaactgtgaagaaaaggaagagagacttatgctgctggaatcttggcgaagttttgaagaagaatttggaacagcttcagataaggagagagtagacaaactcatgccagagaaagtcaagaagagaagaaaggtccagactgatgatgggtctgatgcaggctgggaagaatactttgattacatctttccagaagatgctgccaaccaacctaacctcaaactcctggccatggccaaactgtggaagaaacagcagcaggaaaaggaggatgctgagcaccatccagatgaggacgtcgatgagagtgaatcctgatctttttttcatagacaaatgttttgttatttttataaattaattgtttggaactcttgtgactcctggaagttcttatatatttcaccagtaagaaattgattggtatctttgatggctactttttaagttattttttaaatgctcttgggttagctaggggtagggattgcaagtaaaggacttttttaactgctggatttgtttttccaactgagtccaaacttttctaatgtctgtccacatcatgcattaggaaatgtaattaaggtaacattctacagttacttttcatgtcatacccataaagatagtttatgcattcatctgaaatgtgtaactttttcatgtcttcagagtcacagacttgagttcatttcccagctctgccactcatgattatataacttaattttcattttcctcattcacaaaatgggccaatagtttgacagctcattttgaagattacattataaaaggaatatacctggtgggtgcatagtaagtgctcagtaaattgtttgttctaagccacttttaaaaatggtttcattccttgtagaattgaatgcgagtggattaataatttaccttactttcttactagtgtccagttatattgttttttagaacaacacttggaaaataatttgcagtgattatatttctgaacaaggttcagaaaacattgtttactaagaatttagtctaataatttcagttaggcgctcatcagttctccagagtggttgagtttgtaataccttgtttaaagaataatggcttgttcacgtgtgtgctatgaaaaatgatgtcccatgttcacataaatttgggaaattctgg

SEQ ID NO: 286442 - DNA, 4310 bp, Homo sapiens
agctgttccaaggattcaagctttggtcagtttgagcttgtcttcagagaaaagaaggaagtttgactaaatgcagacaaatttatgaagaagctaacaaaaccatgcgaaactgtgaagaagaggaagagagacttatgctgctggaatcttggcgaagttttgaagaagaatttggaacagcttcagataaggagagagtagacaaactcatgccagagaaagtcaagaagagaagaaaggtccagaccgatgatgggtctgatgcaggctgggaagaatactttgattacatctttccagaagatgctgccaaccaacctaacctcaaactcctggccatggccaaggtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaagacttttgaagataatataagaaaaaacaggactgtgattagtaactggataaaatacgcacaatgggaagaaagcctaaaggagattcaaagggctcgatccatatacgagcgtgctttagatgtagactaccgaaatattacactctggctgaaatacgcagaaatggaaatgaagaatcgccaagtcaaccatgctcgaaatatctgggaccgggccataacaacgctgcctcgagttaatcagttctggtacaagtacacgtacatggaggaaatgttgggaaacgttgccggtgcccggcaggtgtttgagcgctggatggagtggcagcctgaggagcaagcctggcactcctacatcaactttgagctgagatacaaagaggtggatcgggcccgcaccatttatgagcgatttgtcctcgtgcaccctgatgttaagaactggatcaagtatgcccgctttgaagattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctgagaggacaagacaggtgtatcaagcctctttggaactaattcctcacaaaaagttcacatttgccaaaatgtggatactgtatgcacagtttgaaatacgacagaagaatctgtcattagccagaagagcattgggaacttccataggcaaatgtccaaagaacaaattatttaaagtttacatagaattggagctacagcttcgagaatttgacagatgccggaagctttatgaaaagttcctggaatttggacctgaaaattgtacctcatggattaaattcgctgaattagagacaatccttggtgatattgacagagcacgggcaatctatgaattagccatcagtcagccacgtttagacatgccagaggtgctttggaaatcatatattgattttgaaattgagcaggaagaaacagaaagaacacgaaacctttaccggcggttgcttcaacggacgcagcatgtcaaggtatggatcagctttgctcagtttgagttgtcttcaggaaaagaaggaagtttgactaaatgcagacaaatttatgaagaagctaacaaaaccatgcgaaactgtgaagaaaaggaagagagacttatgctgctggaatcttggcgaagttttgaagaagaatttggaacagcttcagataaggagagagtagacaaactcatgccagagaaagtcaagaagagaagaaaggtccagactgatgatgggtctgatgcaggctgggaagaatactttgattacatctttccagaagatgctgccaaccaacctaacctcaaactcctggccatggccaaactgtggaagaaacagcagcaggaaaaggaggatgctgagcaccatccagatgaggacgtcgatgagagtgaatcctgatctttttttcatagacaaatgttttgttatttttataaattaattgtttggaactcttgtgactcctggaagttcttatatatttcaccagtaagaaattgattggtatctttgatggctactttttaagttattttttaaatgctcttgggttagctaggggtagggattgcaagtaaaggacttttttaactgctggatttgtttttccaactgagtccaaacttttctaatgtctgtccacatcatgcattaggaaatgtaattaaggtaacattctacagttacttttcatgtcatacccataaagatagtttatgcattcatctgaaatgtgtaactttttcatgtcttcagagtcacagacttgagttcatttcccagctctgccactcatgattatataacttaattttcattttcctcattcacaaaatgggccaatagtttgacagctcattttgaagattacattataaaaggaatatacctggtgggtgcatagtaagtgctcagtaaattgtttgttctaagccacttttaaaaatggtttcattccttgtagaattgaatgcgagtggattaataatttaccttactttcttactagtgtccagttatattgttttttagaacaacacttggaaaataatttgcagtgattatatttctgaacaaggttcagaaaacattgtttactaagaatttagtctaataatttcagttaggcgctcatcagttctccagagtggttgagtttgtaataccttgtttaaagaataatggcttgttcacgtgtgtgctatgaaaaatgatgtcccatgttcacataaatttgggaaattctggactaagacttaagtctcgttaatcaaatctctttatagttaggcttctgtacattatgtatctccagtagcaatgttgccatattatttatttcccaaacttagtggacaatggagtcatttctacctagagtaccagtaaacatctcccagtgtgctatagtagaaaatgtctactcctcactgctgacatgttaaacttactcttggtttagagcatgtgtagaaacacctaaggtagctctatgctaaataatgaagagtagcacaagaatgaatgtatttgctgatacgttgctcacattctcaagcaaaaattcaactgcattaaccgatctgagagttttcctttaacctggactgtgtttctcaagcacattttttctttgttcactgcccaaggactagaactgtatttttaaggttgttttcccctaaaaggacctttagtaagcaaatttattattaaatgtgcacatcttattcacccaagggaataaaagctacttcgtaatgttgttactaaattttatcttgaaaataaataacagtgtttgaggacagaagaaactaggactgttgttgagataaaatctgttttcagcctgactgctttagtcactggacgagcatcagctactgcggtgtcagatcacttctcgagtagaggtctgcctagtgagtgagcaggagaacatcatcttaatagcctttggctcacccagagtcagggagagatgaaaataataggtcagaatgcaagtgacttaatcacagtcttcctagaattatctgtttgtttatgttgcatgaatgcataagaaaaaaattctgtcatgttcccaaggtagaattgtaataagcatgtgccagtgtgaaagctggaaggaaaaaagctattctctaacaggagaacataaagattcatttctctcccaccctcaactccaccaaagtaaatcctttcgatagtaaaagtttaataatttcttgtgggtttttctttcgttaagtctttcactaactaactaactggatattttcacatattacagaggaagacactacacataaaatacatggttggcctatgatatagttatatggcctttctttaggaattatgttcttttccctctccaaaaaaaaaa

SEQ ID NO: 286443 - DNA, 3962 bp, Homo sapiens
ttaattattagttcaagtattcatattttaatataattggtgctatttaatgaccagaccattattgaccgcttacggtgccatgttcttttggctagaaactgtgctaagggctttacatacattttctcatttaaagctggcagtaatccagtgaggctggcattatttttccctgtttacaaatgaaacagctgagacttagacgtctaagttcagtgactaatccaagatcacatggttggtaacctgggttgagatttttctttgcttccaactcgagtttatacccaccactaaaatcttaactaagcactggaggaaaatagagatgaacaggcgtggccctgctctcacagaagccactgtttaattctacacttttgtatgtgttttgttcccctagagttgtagtttgaatttttggagtttccaggctttggtatggttttggtgtttacttacttactatttttttaagccatgctgttttgcctgggatttccttaattcccttgcacttgtcctcgtgcaccctgatgttaagaactggatcaagtatgcccgctttgaagaaaaacatgcttattttgcccatgcacggaaagtgtatgagagagctgtggaattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctgagaggacaagacaggtgtatcaagcctctttggaactaattcctcacaaaaagttcacatttgccaaaatgtggatactgtatgcacagtttgaaatacgacagaagaatctgtcattagccagaagagcattgggaacttccataggcaaatgtccaaagaacaaattatttaaagtttacatagaattggagctacagcttcgagaatttgacagatgccggaagctttatgaaaagttcctggaatttggacctgaaaattgtacctcatggattaaattcgctgaattagagacaatccttggtgatattgacagagcacgggcaatctatgaattagccatcagtcagccacgtttagacatgccagaggtgctttggaaatcatatattgattttgaaattgagcaggaagaaacagaaagaacacgaaacctttaccggcggttgcttcaacggacgcagcatgtcaaggtatggatcagctttgctcagtttgagttgtcttcaggaaaagaaggaagtttgactaaatgcagacaaatttatgaagaagctaacaaaaccatgcgaaactgtgaagaaaaggaagagagacttatgctgctggaatcttggcgaagttttgaagaagaatttggaacagcttcagataaggagagagtagacaaactcatgccagagaaagtcaagaagagaagaaaggtccagactgatgatgggtctgatgcaggctgggaagaatactttgattacatctttccagaagatgctgccaaccaacctaacctcaaactcctggccatggccaaactgtggaagaaacagcagcaggaaaaggaggatgctgagcaccatccagatgaggacgtcgatgagagtgaatcctgatctttttttcatagacaaatgttttgttatttttataaattaattgtttggaactcttgtgactcctggaagttcttatatatttcaccagtaagaaattgattggtatctttgatggctactttttaagttattttttaaatgctcttgggttagctaggggtagggattgcaagtaaaggacttttttaactgctggatttgtttttccaactgagtccaaacttttctaatgtctgtccacatcatgcattaggaaatgtaattaaggtaacattctacagttacttttcatgtcatacccataaagatagtttatgcattcatctgaaatgtgtaactttttcatgtcttcagagtcacagacttgagttcatttcccagctctgccactcatgattatataacttaattttcattttcctcattcacaaaatgggccaatagtttgacagctcattttgaagattacattataaaaggaatatacctggtgggtgcatagtaagtgctcagtaaattgtttgttctaagccacttttaaaaatggtttcattccttgtagaattgaatgcgagtggattaataatttaccttactttcttactagtgtccagttatattgttttttagaacaacacttggaaaataatttgcagtgattatatttctgaacaaggttcagaaaacattgtttactaagaatttagtctaataatttcagttaggcgctcatcagttctccagagtggttgagtttgtaataccttgtttaaagaataatggcttgttcacgtgtgtgctatgaaaaatgatgtcccatgttcacataaatttgggaaattctggactaagacttaagtctcgttaatcaaatctctttatagttaggcttctgtacattatgtatctccagtagcaatgttgccatattatttatttcccaaacttagtggacaatggagtcatttctacctagagtaccagtaaacatctcccagtgtgctatagtagaaaatgtctactcctcactgctgacatgttaaacttactcttggtttagagcatgtgtagaaacacctaaggtagctctatgctaaataatgaagagtagcacaagaatgaatgtatttgctgatacgttgctcacattctcaagcaaaaattcaactgcattaaccgatctgagagttttcctttaacctggactgtgtttctcaagcacattttttctttgttcactgcccaaggactagaactgtatttttaaggttgttttcccctaaaaggacctttagtaagcaaatttattattaaatgtgcacatcttattcacccaagggaataaaagctacttcgtaatgttgttactaaattttatcttgaaaataaataacagtgtttgaggacagaagaaactaggactgttgttgagataaaatctgttttcagcctgactgctttagtcactggacgagcatcagctactgcggtgtcagatcacttctcgagtagaggtctgcctagtgagtgagcaggagaacatcatcttaatagcctttggctcacccagagtcagggagagatgaaaataataggtcagaatgcaagtgacttaatcacagtcttcctagaattatctgtttgtttatgttgcatgaatgcataagaaaaaaattctgtcatgttcccaaggtagaattgtaataagcatgtgccagtgtgaaagctggaaggaaaaaagctattctctaacaggagaacataaagattcatttctctcccaccctcaactccaccaaagtaaatcctttcgatagtaaaagtttaataatttcttgtgggtttttctttcgttaagtctttcactaactaactaactggatattttcacatattacagaggaagacactacacataaaatacatggttggcctatgatatagttatatggcctttctttaggaattatgttcttttccctctccaaaaaaaaaa

SEQ ID NO: 286444 - DNA, 2793 bp, Homo sapiens
agctgttccaaggattcaagctttggtcagtttgagcttgtcttcagagaaaagaaggaagtttgactaaatgcagacaaatttatgaagaagctaacaaaaccatgcgaaactgtgaagaagaggaagagagacttatgctgctggaatcttggcgaagttttgaagaagaatttggaacagcttcagataaggagagagtagacaaactcatgccagagaaagtcaagaagagaagaaaggtccagaccgatgatgggtctgatgcaggctgggaagaatactttgattacatctttccagaagatgctgccaaccaacctaacctcaaactcctggccatggccaagctgtggaagaaacagcagcatgtcaaggtatggatcagctttgctcagtttgagttgtcttcaggaaaagaaggaagtttgactaaatgcagacaaatttatgaagaagctaacaaaaccatgcgaaactgtgaagaaaaggaagagagacttatgctgctggaatcttggcgaagttttgaagaagaatttggaacagcttcagataaggagagagtagacaaactcatgccagagaaagtcaagaagagaagaaaggtccagactgatgatgggtctgatgcaggctgggaagaatactttgattacatctttccagaagatgctgccaaccaacctaacctcaaactcctggccatggccaaactgtggaagaaacagcagcaggaaaaggaggatgctgagcaccatccagatgaggacgtcgatgagagtgaatcctgatctttttttcatagacaaatgttttgttatttttataaattaattgtttggaactcttgtgactcctggaagttcttatatatttcaccagtaagaaattgattggtatctttgatggctactttttaagttattttttaaatgctcttgggttagctaggggtagggattgcaagtaaaggacttttttaactgctggatttgtttttccaactgagtccaaacttttctaatgtctgtccacatcatgcattaggaaatgtaattaaggtaacattctacagttacttttcatgtcatacccataaagatagtttatgcattcatctgaaatgtgtaactttttcatgtcttcagagtcacagacttgagttcatttcccagctctgccactcatgattatataacttaattttcattttcctcattcacaaaatgggccaatagtttgacagctcattttgaagattacattataaaaggaatatacctggtgggtgcatagtaagtgctcagtaaattgtttgttctaagccacttttaaaaatggtttcattccttgtagaattgaatgcgagtggattaataatttaccttactttcttactagtgtccagttatattgttttttagaacaacacttggaaaataatttgcagtgattatatttctgaacaaggttcagaaaacattgtttactaagaatttagtctaataatttcagttaggcgctcatcagttctccagagtggttgagtttgtaataccttgtttaaagaataatggcttgttcacgtgtgtgctatgaaaaatgatgtcccatgttcacataaatttgggaaattctggactaagacttaagtctcgttaatcaaatctctttatagttaggcttctgtacattatgtatctccagtagcaatgttgccatattatttatttcccaaacttagtggacaatggagtcatttctacctagagtaccagtaaacatctcccagtgtgctatagtagaaaatgtctactcctcactgctgacatgttaaacttactcttggtttagagcatgtgtagaaacacctaaggtagctctatgctaaataatgaagagtagcacaagaatgaatgtatttgctgatacgttgctcacattctcaagcaaaaattcaactgcattaaccgatctgagagttttcctttaacctggactgtgtttctcaagcacattttttctttgttcactgcccaaggactagaactgtatttttaaggttgttttcccctaaaaggacctttagtaagcaaatttattattaaatgtgcacatcttattcacccaagggaataaaagctacttcgtaatgttgttactaaattttatcttgaaaataaataacagtgtttgaggacagaagaaactaggactgttgttgagataaaatctgttttcagcctgactgctttagtcactggacgagcatcagctactgcggtgtcagatcacttctcgagtagaggtctgcctagtgagtgagcaggagaacatcatcttaatagcctttggctcacccagagtcagggagagatgaaaataataggtcagaatgcaagtgacttaatcacagtcttcctagaattatctgtttgtttatgttgcatgaatgcataagaaaaaaattctgtcatgttcccaaggtagaattgtaataagcatgtgccagtgtgaaagctggaaggaaaaaagctattctctaacaggagaacataaagattcatttctctcccaccctcaactccaccaaagtaaatcctttcgatagtaaaagtttaataatttcttgtgggtttttctttcgttaagtctttcactaactaactaactggatattttcacatattacagaggaagacactacacataaaatacatggttggcctatgatatagttatatggcctttctttaggaattatgttcttttccctctccaaaaaaaaaa

SEQ ID NO: 286445 - DNA, 2595 bp, Homo sapiens
ctttccgacactctttgggaagagaatctctaatgacggcaacagtggagaacctaacgttccagaaggacactttgggaaatgctgttgacaaaaacaggcgccacggctcgacagagccactcgtcctcgcctggtcatcccagttccggaggctgacctggggatgcgccctggacgccctgcaccgcagtccttgcgtcgctgctagtcagcacggcgttacccacctcatccgcagctccaggacgccgcactccacgcgctgccgcaaggaggacgcgcagcctggtcaccatggaaacggtgccgcctccgtcacggctcaagcgagaggtcaaaggtcagtcctgcaagttccgcttccggttccgagatcctgtttgttttctgaaagctttgtggtttcggtgagctctcagagccgatttctagcgtccgtgccggggacaggtgtccagaggtcgactgctgcagacatggcggcctccaccgcggccgggaagcagcggattcccaaagtggccaaggtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaagacttttgaagataatataagaaaaaacaggactgtgattagtaactggataaaatacgcacaatgggaagaaagcctaaaggagattcaaagggctcgatccatatacgagcgtgctttagatgtagactaccgaaatattacactctggctgaaatacgcagaaatggaaatgaagaatcgccaagtcaaccatgctcgaaatatctgggaccgggccataacaacgctgcctcgagttaatcagttctggtacaagtacacgtacatggaggaaatgttgggaaacgttgccggtgcccggcaggtgtttgagcgctggatggagtggcagcctgaggagcaagcctggcactcctacatcaactttgagctgagatacaaagaggtggatcgggcccgcaccatttatgagcgatttgtcctcgtgcaccctgatgttaagaactggatcaagtatgcccgctttgaagaaaaacatgcttattttgcccatgcacggaaagtgtatgagagagctgtggaattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctgagaggacaagacaggtgtatcaagcctctttggaactaattcctcacaaaaagttcacatttgccaaaatgtggatactgtatgcacagtttgaaatacgacagaagaatctgtcattagccagaagagcattgggaacttccataggcaaatgtccaaagaacaaattatttaaagtttacatagaattggagctacagcttcgagaatttgacagatgccggaagctttatgaaaagttcctggaatttggacctgaaaattgtacctcatggattaaattcgctgaattagagacaatccttggtgatattgacagagcacgggcaatctatgaattagccatcagtcagccacgtttagacatgccagaggtgctttggaaatcatatattgattttgaaattgagcaggaagaaacagaaagaacacgaaacctttaccggcggttgcttcaacggacgcagcatgtcaaggtatggatcagctttgctcagtttgagttgtcttcaggaaaagaaggaagtttgactaaatgcagacaaatttatgaagaagctaacaaaaccatgcgaaactgtgaagaaaaggaagagagacttatgctgctggaatcttggcgaagttttgaagaagaatttggaacagcttcagataaggagagagtagacaaactcatgccagagaaagtcaagaagagaagaaaggtccagactgatgatgggtctgatgcaggctgggaagaatactttgattacatctttccagaagatgctgccaaccaacctaacctcaaactcctggccatggccaaactgtggaagaaacagcagcaggaaaaggaggatgctgagcaccatccagatgaggacgtcgatgagagtgaatcctgatctttttttcatagacaaatgttttgttatttttataaattaattgtttgga

SEQ ID NO: 286446 - DNA, 2351 bp, Homo sapiens
  misc_feature (2298)..(2298): n is a, c, g, or t
ctttccgacactctttgggaagagaatctctaatgacggcaacagtggagaacctaacgttccagaaggacactttgggaaatgctgttgacaaaaacaggcgccacggctcgacagagccactcgtcctcgcctggtcatcccagttccggaggctgacctggggatgcgccctggacgccctgcaccgcagtccttgcgtcgctgctagtcagcacggcgttacccacctcatccgcagctccaggacgccgcactccacgcgctgccgcaaggaggacgcgcagcctggtcaccatggaaacggtgccgcctccgtcacggctcaagcgagaggtcaaaggtcagtcctgcaagttccgcttccggttccgagatcctgtttgttttctgaaagctttgtggtttcggtgagctctcagagccgatttctagcgtccgtgccggggacaggtgtccagaggtcgactgctgcagacatggcggcctccaccgcggccgggaagcagcggattcccaaagtggccaaggtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaagacttttgaagataatataagaaaaaacaggactgtgattagtaactggataaaatacgcacaatgggaagaaagcctaaaggagattcaaagggctcgatccatatacgagcgtgctttagatgtagactaccgaaatattacactctggctgaaatacgcagaaatggaaatgaagaatcgccaagtcaaccatgctcgaaatatctgggaccgggccataacaacgctgcctcgagttaatcagttctggtacaagtacacgtacatggaggaaatgttgggaaacgttgccggtgcccggcaggtgtttgagcgctggatggagtggcagcctgaggagcaagcctggcactcctacatcaactttgagctgagatacaaagaggtggatcgggcccgcaccatttatgagcgatttgtcctcgtgcaccctgatgttaagaactggatcaagtatgcccgctttgaagaaaaacatgcttattttgcccatgcacggaaagtgtatgagagagctgtggaattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctgagaggacaagacaggtgtatcaagcctctttggaactaattcctcacaaaaagttcacatttgccaaaatgtggatactgtatgcacagtttgaaatacgacagaagaatctgtcattagccagaagagcattgggaacttccataggcaaatgtccaaagaacaaattatttaaagtttacatagaattggagctacagcttcgagaatttgacagatgccggaagctttatgaaaagttcctggaatttggacctgaaaattgtacctcatggattaaattcgctgaattagagacaatccttggtgatattgacagagcacgggcaatctatgaattagccatcagtcagccacgtttagacatgccagaggtgctttggaaatcatatattgattttgaaattgagcaggaagaaacagaaagaacacgaaacctttaccggcggttgcttcaacggacgcagcatgtcaaggtatggatcagctttgctcagtttgagttgtcttcaggaaaagaaggaagtttgactaaatgcagacaaatttatgaagaagctaacaaaaccatgcgaaactgtgaagaaaaggaagagagactgtttgaggttaatagattttagagagtccattgaagaagggaattgncccgggattgagaacaaaaaatcctcagggacatttagatttagtggacgagt

SEQ ID NO: 286447 - DNA, 1473 bp, Homo sapiens
  misc_feature (1417)..(1417): n is a, c, g, or t
  misc_feature (1450)..(1450): n is a, c, g, or t
  misc_feature (1458)..(1458): n is a, c, g, or t
ctttccgacactctttgggaagagaatctctaatgacggcaacagtggagaacctaacgttccagaaggacactttgggaaatgctgttgacaaaaacaggcgccacggctcgacagagccactcgtcctcgcctggtcatcccagttccggaggctgacctggggatgcgccctggacgccctgcaccgcagtccttgcgtcgctgctagtcagcacggcgttacccacctcatccgcagctccaggacgccgcactccacgcgctgccgcaaggaggacgcgcagcctggtcaccatggaaacggtgccgcctccgtcacggctcaagcgagaggtcaaaggtcagtcctgcaagttccgcttccggttccgagatcctgtttgttttctgaaagctttgtggtttcggtgagctctcagagccgatttctagcgtccgtgccggggacaggtgtccagaggtcgactgctgcagacatggcggcctccaccgcggccgggaagcagcggattcccaaagtggccaaggtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaagacttttgaagataatataagaaaaaacaggactgtgattagtaactggataaaatacgcacaatgggaagaaagcctaaaggagattcaaagggctcgatccatatacgagcgtgctttagatgtagactaccgaaatattacactctggctgaaatacgcagaaatggaaatgaagaatcgccaagtcaaccatgctcgaaatatctgggaccgggccataacaacgctgcctcgagttaatcagttctggtacaagtacacgtacatggaggaaatgttgggaaacgttgccggtgcccggcaggtgtttgagcgctggatggagtggcagcctgaggagcaagcctggcactcctacatcaactttgagctgagatacaaagaggtggatcgggcccgcaccatttatgagcgatttgtcctcgtgcaccctgatgttaagaactggatcaagtatgcccgctttgaagaaaaacatgcttattttgcccatgcacggaaagtgtatgagagagctgtggaattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcgggggtttttaaaaatttctttgtnaagccaaaccggaaaattccccgtttccaaaanaaaaaaantttaaagggcgaaat

SEQ ID NO: 286448 - DNA, 1097 bp, Homo sapiens
  misc_feature (686)..(686): n is a, c, g, or t
  misc_feature (689)..(689): n is a, c, g, or t
  misc_feature (691)..(691): n is a, c, g, or t
ctttccgacactctttgggaagagaatctctaatgacggcaacagtggagaacctaacgttccagaaggacactttgggaaatgctgttgacaaaaacaggcgccacggctcgacagagccactcgtcctcgcctggtcatcccagttccggaggctgacctggggatgcgccctggacgccctgcaccgcagtccttgcgtcgctgctagtcagcacggcgttacccacctcatccgcagctccaggacgccgcactccacgcgctgccgcaaggaggacgcgcagcctggtcaccatggaaacggtgccgcctccgtcacggctcaagcgagaggtcaaaggtcagtcctgcaagttccgcttccggttccgagatcctgtttgttttctgaaagctttgtggtttcggtgagctctcagagccgatttctagcgtccgtgccggggacaggtgtccagaggtcgactgctgcagacatggcggcctccaccgcggccgggaagcagcggattcccaaagtggccaaggtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaagaanaananaaaaaaaaaaaaaaaaacaccgcgcgaaagttttctctctctctctctctctctcgccccccgggggggccccaaaaggggggggccccccgcgcgggggtctccggaaaaaggaggccaccttgtgagtgacacagtgggatttctcgcggaaagcccctgcactgtggggggccccgtgcggagccccgcgggggggcctctctttcttatgagagagctggggtgccccctatactctccggcggggggggccatacagaaaaccctcgtggcccctgggtatctaggaatttcgtgggggcactatacccctcgggggtgtggggggccaccagctctttaacagcggggctctctagagagcacgtgggaacacaacgctctcgggggtcgtgtcccccga

SEQ ID NO: 286449 - DNA, 717 bp, Homo sapiens
cagagccactcgtcctcgcctggtcatcccagttccggaggctgacctggggatgcgccctggacgccctgcaccgcagtccttgcgtcgctgctagtcagcacggcgttacccacctcatccgcagctccaggacgccgcactccacgcgctgccgcaaggaggacgcgcagcctggtcaccatggaaacggtgccgcctccgtcacggctcaagcgagaggtcaaaggtcagtcctgcaagttccgcttccggttccgagatcctgtttgttttctgaaagctttgtggtttcggtgagctctcagagccgatttctagcgtccgtgccggggacaggtgtccagaggtcgactgctgcagacatggcggcctccaccgcggccgggaagcagcggattcccaaagtggccaaggtaggcgatcgcgaggggccttgtaggaggtggcctaggaaaggggcatccctcagccctgagggtgcccgggttgggagagagtgttcccgccggggagaaggctcaccctgagagatggagaggaagggcagctggtggtggggcgcgggctcttgtcatcgcggagcacgacccgcgttggcgtggccttcgttctggggtggttttgctggggagtggagtggggtggttcggtgaagatttactgagccaggcactgcactgggcgctgggaagctacgctcgtacgctggccaca

SEQ ID NO: 286450 - DNA, 535 bp, Homo sapiens
gagttacttttcagaatagaggtaggacattctgcccatatacaagcatgcctacaaaacaaagtctgttctgagcagaggctaccgtgccatacagtacagtacagtatctggatcatggttctcaggagaggttaccatgccatgcagtacaatatagtatctggatcatggtatgtgggtttctaacttttgtgaaatgaatgtggtctttgcttgtaaataagcagagtacattcctcttactctgaagttttagagaaatcgaattaccaatggctttggttaatttaaattaattttaattcaatttaatttggatgaggcttttaagctagatatttttgtgcttttgttttctagttcacatttgccaaaatgtggatactgtatgcacagtttgaaatacgacagaagaatctgtcattagccagaagagcattggtaagtaaagaaaggatcaagatgtctcatcaagttctatgagaaagaaattaaaatcttggtgcttggaagttgtacagttcctacttta

SEQ ID NO: 286451 - DNA, 2507 bp, Homo sapiens
gagcaggagccgcccccagccaagctgctttcagcacagcgtgggcccccagcaccttggtgcggggtgcggcccctcggaggagggctgtcaggtgaagcctcgtgtgagggggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgactttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgagaaaagcgtct

SEQ ID NO: 286452 - DNA, 3012 bp, Homo sapiens
  misc_feature (130)..(130): n is a, c, g, or t
catcacctttttttaagtagtaagaataaagccactgtatgattctcttaatagctatacattaatcctgtttttagtgctgactgggccagccttccgggaactggagtctgtctctttcagtgctttnttgttttttgttggttttttcgagacggggtcgatcacggctcaccacagccttaacctccagggctccagcaatcctcccacctcagcctcctgagtagctgggaccacaggtgtgtgccaccatctccagcagtttgtttatttattttttctttttttttttttggtagaaatgggcttttcgccatgttgcccaagctggtcttgcacttctgggctgaagcaatcctctcgccttggcctcccagagccttgggattacagaatcatgggtgagagctggcatggcccctagaggtcatttggggtccagctgcctcaccgtatcaatgaggaaactgaggcccagaaaagaaaagcatttttgcccagagtccctcagaaaaaaacagaccacatctgatccttggccctgagtccagagtgggaggcaccgtgacaacaatgcgcagagcagggaatgcagggagccatggatagtgctggggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgactttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgagaaaagcgtct

SEQ ID NO: 286453 - DNA, 2600 bp, Homo sapiens
aattttcagctgttctttgctcaataataacttttttatcaccaagatatctctctaagtttttgacatattcctcatttgttttgataaaagttttcttattttcttagaaaaataagttactaaaagtcatatatcattgtatatcttcaaaatattgcttaaaactaggacttgtatttaaatgttttttcttcttaaagacaagtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgactttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgagaaaagcgtct

SEQ ID NO: 286454 - DNA, 2726 bp, Homo sapiens
agcgtggagtgtggcgctgaggaagcggcgggacggatgcgagcccgggaggagcgcgctggggggccgcaggcgggggatgtggcgcggtccaggcccgtcgcggcctcgtcctgacagggacacctgcgggatcgtccttccaggatcgcctgcgggcctcgcgggccgatgcctcgggtccccctccggcctcggtttctccgcgcagcggggcggggcgggggcagcgcgggtctcaaagctgcctgcagggggcgcccgtgagcggcgcggccggagccggagacccagcggccgccgagacagcgggagccggcgtgcgagcggcaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgactttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgagaaaagcgtct

SEQ ID NO: 286455 - DNA, 2487 bp, Homo sapiens
gagcaggagccgcccccagccaagctgctttcagcacagcgtgggcccccagcaccttggtgcggggtgcggcccctcggaggagggctgtcaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgactttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgagaaaagcgtct

SEQ ID NO: 286456 - DNA, 2425 bp, Homo sapiens
tgtcctttcacagggcggctggtgtcccttaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgactttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgagaaaagcgtct

SEQ ID NO: 286457 - DNA, 2708 bp, Homo sapiens
ttttttttttattgtccattctttcatgaaatctaggccacctttcctacagggctgaggtctgcttactggctggcagatccagccatttcccgagtatgagactgggagtcggtaggcttggatttctgtctggctctcactcaggaagactgagtgatttcgggcagattactgtccccctggacctcagtatttccttgcaaatgttaagatggccatgtaaatgttaacaagtaattctctcatttctctccagagggctgtgggtgggtttggaggggagaaatggcatctcctttggcctgggacctcctcccctcttttaccctccatgctgcctctcctcaagggcttctggagtccccaagtcaaatggcaaatggggaagagaagacagggtatggagtacaagaggcctagatcccctataggtctgatctggctggtgctgcccctagccagtaaagccaccctccagaccccttcaagcctgttgtagccttaaccaagatcaaccaacatggaggtgactgatcttggttaaggctgcgaccaacatggaggtaattgatcttggttaaggctacgacacgtttccctttagagaaaaatcatgttttccccctcaaaaaatcatgcgttaatttcctccaaccaaactaagtcccaggactactccgaaaactactcaatgaccatctgggcatttgtacatgggtttccatttcttggatgcctgctctcctgttacctcccagaagcctgtgaaaaaggcaaggcatattacttccacttaacggaagaggatgctggggcgaggtggcaggaaatgactggtccaagaccttacagtcaggaaatgtggaaacgggtgctgctctggggttctgaactcttggccctgcttaaccctggcttctcagatctctgatgctggtctcttctccccaggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcatggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgactttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgagaaaagcgtct

SEQ ID NO: 286458 - DNA, 2506 bp, Homo sapiens
ttttttttttattgtccattctttcatgaaatctaggccacctttcctacagggctgaggtctgcttactggctggcagatccagccatttcccgagtatgagactgggagtcggtaggcttggatttctgtctggctctcactcaggaagactgagtgatttcgggcagattactgtccccctggacctcagtatttccttgcaaatgttaagatggccatgtaaatgttaacaagtaattctctcatttctctccagagggctgtgggtgggtttggaggggagaaatggcatctcctttggcctgggacctcctcccctcttttaccctccatgctgcctctcctcaagggcttctggagtccccaagtcaaatggcaaatggggaagagaagacagggtatggagtacaagaggcctagatcccctataggtctgatctggctggtgctgcccctagccagtaaagccaccctccagaccccttcaagcctgttgtagccttaaccaagatcaaccaacatggaggtgactgatcttggttaaggctgcgaccaacatggaggtaattgatcttggttaaggctacgacacgtttccctttagagaaaaatcatgttttccccctcaaaaaatcatgcgttaatttcctccaaccaaactaagtcccaggactactccgaaaactactcaatgaccatctgggcatttgtacatgggtttccatttcttggatgcctgctctcctgttacctcccagaagcctgtgaaaaaggcaaggcatattacttccacttaacggaagaggatgctggggcgaggtggcaggaaatgactggtccaagaccttacagtcaggaaatgtggaaacgggtgctgctctggggttctgaactcttggccctgcttaaccctggcttctcagatctctgatgctggtctcttctccccaggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcatggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgagaaaagcgtct

SEQ ID NO: 286459 - DNA, 1063 bp, Homo sapiens
agcgtggagtgtggcgctgaggaagcggcgggacggatgcgagcccgggaggagcgcgctggggggccgcaggcgggggatgtggcgcggtccaggcccgtcgcggcctcgtcctgacagggacacctgcgggatcgtccttccaggatcgcctgcgggcctcgcgggccgatgcctcgggtccccctccggcctcggtttctccgcgcagcggggcggggcgggggcagcgcgggtctcaaagctgcctgcagggggcgcccgtgagcggcgcggccggagccggagacccagcggccgccgagacagcgggagccggcgtgcgagcggcaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagaagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgagaaaagcgtct

SEQ ID NO: 286460 - DNA, 818 bp, Homo sapiens
cgcgcctcgcggaggatgcctcccccacttgcaatgtgagtcctaagagccagaggtgggaggggctggctctcagttcccgcctcgcggtgtgtgcctgccccgctgcgatggaggtcctaagagcaagggggggaagaggggctggctctggtagattgcaaatgacctgctttttttctgatcccgagctgcgttcggacccctgtcggatagtaaatcccagtaaggtacctgccgtgggcagatctgagctttcttcttggacaccccatacccacagtcctccaggccacccttaagtacaatgttctcctacctaagaaggcatctggattttctctttccttggaaatagtaaagaactactctttgactgtttttgacctcacagtgaacctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatgtttttggtcgagcagacagtttcactttttctgctgagcagagcaaccttgtgttcaacattcagccagccccaggcatggtctacgattagtacgaaaaaggtggagaagcatttcttttaacaaactgattcttctgtatcaaacctggaaaaaaatcatgaaccatctgacatcgtgaacagtctgcagtgggctatggtttcttgacaagtcttatttccttatcatcccattaaatgttgtcattttg

SEQ ID NO: 286461 - DNA, 950 bp, Homo sapiens
  misc_feature (855)..(855): n is a, c, g, or t
  misc_feature (891)..(891): n is a, c, g, or t
  misc_feature (895)..(895): n is a, c, g, or t
  misc_feature (897)..(897): n is a, c, g, or t
  misc_feature (908)..(908): n is a, c, g, or t
  misc_feature (929)..(929): n is a, c, g, or t
  misc_feature (938)..(938): n is a, c, g, or t
  misc_feature (943)..(943): n is a, c, g, or t
cgcgcctcgcggaggatgcctcccccacttgcaatgtgagtcctaagagccagaggtgggaggggctggctctcagttcccgcctcgcggtgtgtgcctgccccgctgcgatggaggtcctaagagcaagggggggaagaggggctggctctggtagattgcaaatgacctgctttttttctgatcccgagctgcgttcggacccctgtcggatagtaaatcccagtaaggtacctgccgtgggcagatctgagctttcttcttggacaccccatacccacagtcctccaggccacccttaagtacaatgttctcctacctaagaaggcatctggattttctctttccttggaaatagtaaagaactactctttgactgtttttgacctcacagtgaacctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatgtttttggtcgagcagacagtttcactttttctgctgagcagagcaaccttgtgttcaacattcagccagccccaggcatggtctacgattagtacgaaaaaggtggagaagcatttcttttaacaaactgattcttctgtatcaaacctggaaaaaaatcatgaaccatctgacatcgtgaacagtctgcagtgggctatggtttcttgacaagtcttatttccttatcatcccattaaatgttgtcattttgaaaaaaaaaaaaaaaaaaaaaaaaaaaaaaaaaaaanaaaaaaaaaaaaaaaaaaaaaaaaaaaaaaaaaaanaaananaaaaaaaaaanaaaaaaaaaaaaaaaaaaaanagaaaaaangaaanaaagaaa

SEQ ID NO: 286462 - DNA, 760 bp, Homo sapiens
acctggacaatacacagtagatgtggaaggacgcggttgtacatttatccaggccacccttaagtacaatgttctcctacctaagaaggcatctggattttctctttccttggaaatagtaaagaactactctttgactgtttttgacctcacagtgaacctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatgtttttggtcgagcagacagtttcactttttctgctgagcagagcaaccttgtgttcaacattcagccagccccaggcatggtctacgattagtacgaaaaaggtaggcaagcaacagccatgccctaaggttattgaatgtggtgtttatatctaacattccctgagctactaaactttccaaaatcaacctctgtcttcacagagtaaacaataaatggcattactttgtgttctggtttctttatcccatgatgtgtcttctgactgaacccattttccagttaccagagtttttcaacaccagaatccttgcaatataacctgacagggctccacttgaacttgaaatacaagccacactaagcttccaggtctttttgttattgtcattgttgttcatgctaagactgactgttccaagctacttctgtg

SEQ ID NO: 286463 - DNA, 788 bp, Homo sapiens
tgccagaagtttttcctttaactcctgaaagccttcctgttgttgggatccccattccaaagcttcccggtccccgccccctttgtgacctcatacaaaggcttggctaatactgcaaagtttgggatccacagtctacaaaaccccacagctcctaagaattctctcacctgccttctgcccttaggctccggtagattgcaaacgacctgctttcttcctgatcccgggctgcgttcggacccctgtggtatagtaaatcccaagtaaggtacctgcggtcggcagatctgagctttcttcttggacacctaatacccagggtcctccaggccacccttaagtacaatgttctcctacctaagaaggcatctggattttctctttccttggaaatagtaaagaactactctttgactgtttttgacctcacagtgaacctcaaagtcttactttgtcacccaggctgcagtacagtggcacagtggcacaatctcagctcactgcaacttccagctcctgggttcaaaggattcttacggctcagcctcctgagtagctgggattagaggcgtgcaccaccacatctggctaatttttctatttttagtagagtcagagttttgccatattggccaggctggtcttgaactctgaccctcaagtgatccacccaccttggcctccagaagtgctgggattacaggtgtgagcaaccacgccctgatgaactatggaactcttaacttcataccccaatagtcttatccagaagcaggaaactgagc

SEQ ID NO: 286464 - DNA, 796 bp, Homo sapiens
tgccagaagtttttcctttaactcctgaaagccttcctgttgttgggatccccattccaaagcttcccggtccccgccccctttgtgacctcatacaaaggcttggctaatactgcaaagtttgggatccacagtctacaaaaccccacagctcctaagaattctctcacctgccttctgcccttaggctccggtagattgcaaacgacctgctttcttcctgatcccgggctgcgttcggacccctgtggtatagtaaatcccaagtaaggtacctgcggtcggcagatctgagctttcttcttggacacctaatacccagggtcctccaggtgggtcctaaggatcttaggattcgcgatgggggtcttagccagggggggaagaggggctggctctcagtccccgcctcgcggggggtgcctccccccctgcgatgggggtccgaagagcctgggggggaagaggggctggctctcatccccgcctctcagggggtgcctccaacccactgcgatgggggtccgaagagcctggggggggaagaggggcaggctctcagtccccgcttcgcggggggagcctccccacacagcgatgggggtcccaagagccaggggggaagtggggctggctctcagttcccgccttggggtgtgtgtctgccctgctgcgatgggggtcctaagagcaagcgggggaagaggggctggctccggtagattgcaaatgacctgctttctttctgatctcgagctgtgttcggacacctgtcggatagtaaatcccaagtaac

SEQ ID NO: 286465 - DNA, 879 bp, Homo sapiens
cgcgcctcgcggaggatgcctcccccacttgcaatgtgagtcctaagagccagaggtgggaggggctggctctcagttcccgcctcgcggtgtgtgcctgccccgctgcgatggaggtcctaagagcaagggggggaagaggggctggctctggtagattgcaaatgacctgctttttttctgatcccgagctgcgttcggacccctgtcggatagtaaatcccagtaaggtacctgccgtgggcagatctgagctttcttcttggacaccccatacccacagtcctccaggtacctgccgtgggcagatctgagctttcttcttggacaccccatacccacagtcctccaggccacccttaagtacaatgttctcctacctaagaaggcatctggattttctctttccttggaaatagtaaagaactactctttgactgtttttgacctcacagtgaacctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatgtttttggtcgagcagacagtttcactttttctgctgagcagagcaaccttgtgttcaacattcagccagccccaggcatggtctacgattagtacgaaaaaggtggagaagcatttcttttaacaaactgattcttctgtatcaaacctggaaaaaaatcatgaaccatctgacatcgtgaacagtctgcagtgggctatggtttcttgacaagtcttatttccttatcatcccattaaatgttgtcattttg

SEQ ID NO: 286466 - DNA, 579 bp, Homo sapiens
acctggacaatacacagtagatgtggaaggacgcggttgtacatttatccaggccacccttaagtacaatgttctcctacctaagaaggcatctggattttctctttccttggaaatagtaaagaactactctttgactgtttttgacctcacagtgaacctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatgtttttggtcgagcagacagtttcactttttctgctgagcagagcaaccttgtgttcaacattcagccagccccaggcatggtctacgattagtacgaaaaaggtggagaagcatttcttttaacaaactgattcttctgtatcaaacctggaaaaaaatcatgaaccatctgacatcgtgaacagtctgcagtgggctatggtttcttgacaagtcttatttccttatcatcccattaaatgttgtcattttg

SEQ ID NO: 286467 - DNA, 1297 bp, Homo sapiens
cgcgcctcgcggaggatgcctcccccacttgcaatgtgagtcctaagagccagaggtgggaggggctggctctcagttcccgcctcgcggtgtgtgcctgccccgctgcgatggaggtcctaagagcaagggggggaagaggggctggctctggtagattgcaaatgacctgctttttttctgatcccgagctgcgttcggacccctgtcggatagtaaatcccagtaaggtacctgccgtgggcagatctgagctttcttcttggacaccccatacccacagtcctccaggccacccttaagtacaatgttctcctacctaagaaggcatctggattttctctttccttggaaatagtaaagaactactctttgactgtttttgacctcacagtgaacctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatgtttttggtcgagcagacagtttcactttttctgctgagcagagcaaccttgtgttcaacattcagccagccccaggcatggtctacgattagtacgaaaaagaagaatatgccctagctttttaccacatcaacagtagttcagtttccgagtgagacaaagcaattactggaagaagtaaagaaattttattacgtcataaaccattgaaaacacatctagtaagaaaatgaaaacctgaataagataggacaatagttgaagaaagaaaagtctctggtacttcattagacttgtgtagctgtgtactgcatgagtaatctgataatcattaagattatattaatttctttaaaaatagctttaaagaattcacagctatatatgtaccttttataaatctctcatttttgttttgtaagttgacaggtcagtaaaaatttaggcatatatatttgtacatatgtgtgtatatgtatatacatgtctatgtgcctatatatgcatgtttttatttctaaatatctatttatatatacatacaaatgtgtttactgtttaaatgatgttttaaatcccaggtggagaagcatttcttttaacaaactgattcttctgtatcaaacctggaaaaaaatcatgaaccatctgacatcgtgaacagtctgcagtgggctatggtttcttgacaagtcttatttccttatcatcccattaaatgttgtcattttg

SEQ ID NO: 286468 - DNA, 995 bp, Homo sapiens
cgcgcctcgcggaggatgcctcccccacttgcaatgtgagtcctaagagccagaggtgggaggggctggctctcagttcccgcctcgcggtgtgtgcctgccccgctgcgatggaggtcctaagagcaagggggggaagaggggctggctctggtagattgcaaatgacctgctttttttctgatcccgagctgcgttcggacccctgtcggatagtaaatcccagtaaggtacctgccgtgggcagatctgagctttcttcttggacaccccatacccacagtcctccaggccacccttaagtacaatgttctcctacctaagaaggcatctggattttctctttccttggaaatagtaaagaactactctttgactgtttttgacctcacagtgaacctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatgtttttggtcgagcagacagtttcactttttctgctgagcagagcaaccttgtgttcaacattcagccagccccaggcatggtctacgattagtacgaaaaagaagaatatgccctagctttttaccacatcaacagtagttcagtttccgagtgagacaaagcaattactggaagaagtaaagaaattttattacgtcataaaccattgaaaacacatctagtaagaaaatgaaaacctgaataagataggacaatagttgaagaaagaaaagtctctggtggagaagcatttcttttaacaaactgattcttctgtatcaaacctggaaaaaaatcatgaaccatctgacatcgtgaacagtctgcagtgggctatggtttcttgacaagtcttatttccttatcatcccattaaatgttgtcattttg

SEQ ID NO: 286469 - DNA, 893 bp, Homo sapiens
cgcgcctcgcggaggatgcctcccccacttgcaatgtgagtcctaagagccagaggtgggaggggctggctctcagttcccgcctcgcggtgtgtgcctgccccgctgcgatggaggtcctaagagcaagggggggaagaggggctggctctggtagattgcaaatgacctgctttttttctgatcccgagctgcgttcggacccctgtcggatagtaaatcccagtaaggtacctgccgtgggcagatctgagctttcttcttggacaccccatacccacagtcctccaggccacccttaagtacaatgttctcctacctaagaaggcatctggattttctctttccttggaaatagtaaagaactactctttgactgtttttgacctcacagtgaacctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatgtttttggtcgagcagacagtttcactttttctgctgagcagagcaaccttgtgttcaacattcagccagccccaggcatggtctacgattagtacgaaaaagaagaatatgccctagctttttaccacatcaacagtagttcagtttccgagtgagacaaagcaattactggaagaagtggagaagcatttcttttaacaaactgattcttctgtatcaaacctggaaaaaaatcatgaaccatctgacatcgtgaacagtctgcagtgggctatggtttcttgacaagtcttatttccttatcatcccattaaatgttgtcattttg

SEQ ID NO: 286470 - DNA, 654 bp, Homo sapiens
acctggacaatacacagtagatgtggaaggacgcggttgtacatttatccaggccacccttaagtacaatgttctcctacctaagaaggcatctggattttctctttccttggaaatagtaaagaactactctttgactgtttttgacctcacagtgaacctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatgtttttggtcgagcagacagtttcactttttctgctgagcagagcaaccttgtgttcaacattcagccagccccaggcatggtctacgattagtacgaaaaagaagaatatgccctagctttttaccacatcaacagtagttcagtttccgagtgagacaaagcaattactggaagaagtggagaagcatttcttttaacaaactgattcttctgtatcaaacctggaaaaaaatcatgaaccatctgacatcgtgaacagtctgcagtgggctatggtttcttgacaagtcttatttccttatcatcccattaaatgttgtcattttg

SEQ ID NO: 286471 - DNA, 759 bp, Homo sapiens
tagcatatttctgcataatgtataaaatgggaaagtaattgtctctatttcaaaattattggaaggattagatctaatgtgcttatatcatctatttaataaaaatacatgttccctttattttttcagaagaatatgccctagctttttaccacatcaacagtagttcagtttccgagtgagacaaagcaattactggaagaagtaaagaaattttattacgtcataaaccattgaaaacacatctagtaagaaaatgaaaacctgaataagataggacaatagttgaagaaagaaaagtctctggtacttcattagacttgtgtagctgtgtactgcatgagtaatctgataatcattaagattatattaatttctttaaaaatagctttaaagaattcacagctatatatgtaccttttataaatctctcatttttgttttgtaagttgacaggtcagtaaaaatttaggcatatatatttgtacatatgtgtgtatatgtatatacatgtctatgtgcctatatatgcatgtttttatttctaaatatctatttatatatacatacaaatgtgtttactgtttaaatgatgttttaaatcccaggtggagaagcatttcttttaacaaactgattcttctgtatcaaacctggaaaaaaatcatgaaccatctgacatcgtgaacagtctgcagtgggctatggtttcttgacaagtcttatttccttatcatcccattaaatgttgtcattttg

SEQ ID NO: 286472 - DNA, 1177 bp, Homo sapiens
tggggcaggagcttctttgtttgaatttgctcctgagaggatgaggcctcctagagcactggctcctggacagcaacctcctttggtgccttgtgaccagggccctgatggttcattagatggagccttcgagtcttagggagttgccgcagggtccccacagcggctcccgacggttgtgaaccagcatccatcctccacggattccggcaacccgcctggccctggacgtgtctcaactggcccgcgtgaggggccgccccggaaatgacgcgctgccccgctggccaagcggaagtggagatggcggagctgtacgtgaagccgggcaacaaggaacgcggctggaacgacccgccgcagttctcatacgggctgcagacccaggccggcggacccaggcgctcgctgcttaccaagagggtagccgcaccccaggatggatcccccagagtccccgcatcagagacttctcctgggcctcccccaatggggcctccacctccttcaagtaaggctcccaggtccccacctgtggggagtggtcctgcctctggcgtggagcccacaagtttcccagtcgagtctgaggctcgactgatggaggatgtgctgagacctttggaacaggcattggaagactgccgtggccacacaaggaagcaggtatgtgatgacatcagccgacgcctggcactgctgcaggaacagtgggctggaggaaagttgtcaatacctgtaaagaagagaatggctctactggtgcaagagctttcaagccaccggtgggacgcagcagatgacatccaccgctccctcatggttgaccatgtgactgaggtcagtcagtggatggtaggagttaaaagattaattgcagaaaagaggagtctgttttcagaggaggcagccaatgaagagaaatctgcagccacagctgagaagaaccataccataccaggcttccagcaggcttcataatcctcggttccccagactcaccggacaccatctcctatgccttggagaccttctgtcacttggctcccttcttaccaccaccaagactgtcccactgggcctgacccacctatgagggaagaagtcccacctgggccagagggagttcatgtgttactcataacatgcatttcaataaaaacatctctgcggtggg

SEQ ID NO: 286473 - DNA, 1775 bp, Homo sapiens
tggggcaggagcttctttgtttgaatttgctcctgagaggatgaggcctcctagagcactggctcctggacagcaacctcctttggtgccttgtgaccagggccctgatggttcattagatggagccttcgagtcttagggagttgccgcagggtccccacagcggctcccgacggttgtgaaccagcatccatcctccacggattccggcaacccgcctggccctggacgtgtctcaactggcccgcgtgaggggccgccccggaaatgacgcgctgccccgctggccaagcggaagtggagatggcggagctgtacgtgaagccgggtgagcgcagccggcgggctagggcactaggttgtcgccccggcctaggctgggggcggttgcggcgcttagtatggaccctctgtctcccccagccccagtataagctaacagtggagttccgggctcgcttcacacatccctcgcctccgcaggcaacaaggaacgcggctggaacgacccgccgcagttctcatacgggctgcagacccaggccggcggacccaggcgctcgctgcttaccaagagggtagccgcaccccaggatggatcccccagagtccccgcatcagagacttctcctgggcctcccccaatggggcctccacctccttcaagtaaggctcccaggtccccacctgtggggagtggtcctgcctctggcgtggagcccacaagtttcccagtcgagtctgaggctcgactgatggaggatgtgctgagacctttggaacaggcattggaagactgccgtggccacacaaggaagcaggtatgtgatgacatcagccgacgcctggcactgctgcaggaacagtgggctggaggaaagttgtcaatacctgtaaagaagagaatggctctactggtgcaagagctttcaagccaccggtgggacgcagcagatgacatccaccgctccctcatggttgaccatgtgactgaggtcagtcagtggatggtaggagttaaaagattaattgcagaaaagaggagtctgttttcagaggaggcagccaatgaagagaaatctgcagccacagctgagaagaaccataccataccaggcttccagcaggcttcataatcctcggttccccagactcaccggacaccatctcctatgccttggagaccttctgtcacttggctcccttcttaccaccaccaagactgtcccactgggcctgacccacctatgagggaagaagtcccacctgggccagagggagttcatgtgttactcataacatgcatttcaataaaaacatctctgcggtgggccttgggtaggagagatgaacccttccggtgccaagctagtcccctctggtgtcctcgactgccctgctccctgtgtatctgcaaacctctgttctcccttctccattcatcaggaagggatctgctgggtaaagtcagactactgcctaccactttttcccaaagtagactgaaagcacatcctgtgctgggcggagcagctgtgtttggatggtttcatttcagcatgagaacagactcaaatagaacggggagacttttccctcaacaaaaggaaagacagtcctatttgcactgtatcacccttgagatactactgttacagagattagaaccacattgagtggggttttctgtgtaaatcgaaggagaaaaagaccagattactgagattggggattgtaactctgacttgccaaacaaactgctgcctcattttggg

SEQ ID NO: 286474 - DNA, 1620 bp, Homo sapiens
tggggcaggagcttctttgtttgaatttgctcctgagaggatgaggcctcctagagcactggctcctggacagcaacctcctttggtgccttgtgaccagggccctgatggttcattagatggagccttcgagtcttagggagttgccgcagggtccccacagcggctcccgacggttgtgaaccagcatccatcctccacggattccggcaacccgcctggccctggacgtgtctcaactggcccgcgtgaggggccgccccggaaatgacgcgctgccccgctggccaagcggaagtggagatggcggagctgtacgtgaagccgggcaacaaggaacgcggctggaacgacccgccgcagttctcatacgggctgcagacccaggccggcggacccaggcgctcgctgcttaccaagagggtagccgcaccccaggatggatcccccagagtccccgcatcagagacttctcctgggcctcccccaatggggcctccacctccttcaagtaaggctcccaggtccccacctgtggggagtggtcctgcctctggcgtggagcccacaagtttcccagtcgagtctgaggctcgactgatggaggatgtgctgagacctttggaacaggcattggaagactgccgtggccacacaaggaagcaggtatgtgatgacatcagccgacgcctggcactgctgcaggaacagtgggctggaggaaagttgtcaatacctgtaaagaagagaatggctctactggtgcaagagctttcaagccaccggtgggacgcagcagatgacatccaccgctccctcatggttgaccatgtgactgaggtcagtcagtggatggtaggagttaaaagattaattgcagaaaagaggagtctgttttcagaggaggcagccaatgaagagaaatctgcagccacagctgagaagaaccataccataccaggcttccagcaggcttcataatcctcggttccccagactcaccggacaccatctcctatgccttggagaccttctgtcacttggctcccttcttaccaccaccaagactgtcccactgggcctgacccacctatgagggaagaagtcccacctgggccagagggagttcatgtgttactcataacatgcatttcaataaaaacatctctgcggtgggccttgggtaggagagatgaacccttccggtgccaagctagtcccctctggtgtcctcgactgccctgctccctgtgtatctgcaaacctctgttctcccttctccattcatcaggaagggatctgctgggtaaagtcagactactgcctaccactttttcccaaagtagactgaaagcacatcctgtgctgggcggagcagctgtgtttggatggtttcatttcagcatgagaacagactcaaatagaacggggagacttttccctcaacaaaaggaaagacagtcctatttgcactgtatcacccttgagatactactgttacagagattagaaccacattgagtggggttttctgtgtaaatcgaaggagaaaaagaccagattactgagattggggattgtaactctgacttgccaaacaaactgctgcctcattttggg

SEQ ID NO: 286475 - DNA, 1447 bp, Homo sapiens
tggggcaggagcttctttgtttgaatttgctcctgagaggatgaggcctcctagagcactggctcctggacagcaacctcctttggtgccttgtgaccagggccctgatggttcattagatggagccttcgagtcttagggagttgccgcagggtccccacagcggctcccgacggttgtgaaccagcatccatcctccacggattccggcaacccgcctggccctggacgtgtctcaactggcccgcgtgaggggccgccccggaaatgacgcgctgccccgctggccaagcggaagtggagatggcggagctgtacgtgaagccgggcaacaaggaacgcggctggaacgacccgccgcagttctcatacgggctgcagacccaggccggcggacccaggcgctcgctgcttaccaagagggtagccgcaccccaggatggatcccccagagtccccgcatcagagacttctcctgggcctcccccaatggggcctccacctccttcaagtaaggctcccaggtccccacctgtggggagtggtcctgcctctggcgtggagcccacaagtttcccagtcgagtctgaggctcgactgatggaggatgtgctgagacctttggaacaggcattggaagactgccgtggccacacaaggaagcaggtatgtgatgacatcagccgacgcctggcactgctgcaggaacagtgggctggaggaaagttgtcaatacctgtaaagaagagaatggctctactggtgcaagagctttcaagccaccggtgggacgcagcagatgacatccaccgctccctcatggttgaccatgtgactgaggtcagtcagtggatggtaggagttaaaagattaattgcagaaaagaggagtctgttttcagaggaggcagccaatgaagagaaatctgcagccacagctgagaagaaccataccataccaggcttccagcaggcttcataatcctcggttccccagactcaccggacaccatctcctatgccttggagaccttctgtcacttggctcccttcttaccaccaccaagactgtcccactgggcctgacccacctatgagggaagaagtcccacctgggccagagggagttcatgtgttactcataacatgcatttcaataaaaacatctctgcggtgggccttgggtaggagagatgaacccttccggtgccaagctagtcccctctggtgtcctcgactgccctgctccctgtgtatctgcaaacctctgttctcccttctccattcatcaggaagggatctgctgggtaaagtcagactactgcctaccactttttcccaaagtagactgaaagcacatcctgtgctgggcggagcagctgtgtttggatggtttcatttcagcatgagaacagactcaggtggtgtgggtaccgagctgaagtcaa

SEQ ID NO: 286476 - DNA, 1332 bp, Homo sapiens
tggggcaggagcttctttgtttgaatttgctcctgagaggatgaggcctcctagagcactggctcctggacagcaacctcctttggtgccttgtgaccagggccctgatggttcattagatggagccttcgagtcttagggagttgccgcagggtccccacagcggctcccgacggttgtgaaccagcatccatcctccacggattccggcaacccgcctggccctggacgtgtctcaactggcccgcgtgaggggccgccccggaaatgacgcgctgccccgctggccaagcggaagtggagatggcggagctgtacgtgaagccgggtgagcgcagccggcgggctagggcactaggttgtcgccccggcctaggctgggggcggttgcggcgcttagtatggaccctctgtctcccccagccccagtataagctaacagtggagttccgggctcgcttcacacatccctcgcctccgcaggcaacaaggaacgcggctggaacgacccgccgcagttctcatacgggctgcagacccaggccggcggacccaggcgctcgctgcttaccaagagggtagccgcaccccaggatggatcccccagagtccccgcatcagagacttctcctgggcctcccccaatggggcctccacctccttcaagtaaggctcccaggtccccacctgtggggagtggtcctgcctctggcgtggagcccacaagtttcccagtcgagtctgaggctcgactgatggaggatgtgctgagacctttggaacaggcattggaagactgccgtggccacacaaggaagcaggtatgtgatgacatcagccgacgcctggcactgctgcaggaacagtgggctggaggaaagttgtcaatacctgtaaagaagagaatggctctactggtgcaagagctttcaagccaccggtgggacgcagcagatgacatccaccgctccctcatggttgaccatgtgactgaggtcagtcagtggatggtaggagttaaaagattaattgcagaaaagaggagtctgttttcagaggaggcagccaatgaagagaaatctgcagccacagctgagaagaaccataccataccaggcttccagcaggcttcataatcctcggttccccagactcaccggacaccatctcctatgccttggagaccttctgtcacttggctcccttcttaccaccaccaagactgtcccactgggcctgacccacctatgagggaagaagtcccacctgggccagagggagttcatgtgttactcataacatgcatttcaataaaaacatctctgcggtggg

SEQ ID NO: 286477 - DNA, 887 bp, Homo sapiens
gcccccgggtgtcgatcggccgagggtacgtgaagcgggcaacaaggaacgcggctggaacgacccgccgcagttctcatacgggctgcagacccaggccggcggacccaggcgctcgctgcttaccaagagggtagccgcaccccaggatggatcccccagagtccccgcatcagagacttctcctgggcctcccccaatggggcctccacctccttcaagtaaggctcccaggtccccacctgtggggagtggtcctgcctctggcgtggagcccacaagtttcccagtcgagtctgaggctcgactgatggaggatgtgctgagacctttggaacaggcattggaagactgccgtggccacacaaggaagcaggtatgtgatgacatcagccgacgcctggcactgctgcaggaacagtgggctggaggaaagttgtcaatacctgtaaagaagagaatggctctactggtgcaagagctttcaagccaccggtgggacgcagcagatgacatccaccgctccctcatggttgaccatgtgactgaggtcagtcagtggatggtaggagttaaaagattaattgcagaaaagaggagtctgttttcagaggaggcagccaatgaagagaaatctgcagccacagctgagaagaaccataccataccaggcttccagcaggcttcataatcctcggttccccagactcaccggacaccatctcctatgccttggagaccttctgtcacttggctcccttcttaccaccaccaagactgtcccactgggcctgacccacctatgagggaagaagtcccacctgggccagagggagttcatgtgttactcataacatgcatttcaataaaaacatctctgcggtggg

SEQ ID NO: 286478 - DNA, 897 bp, Homo sapiens
  misc_feature (30)..(30): n is a, c, g, or t
aacaacatatgtactagtacgagtcccggntgtcatttcggtccaggggcctagcgctgtctgtaatcgattccgtgcgccagttctcatacgggctgcagacccaggccggcggacccaggcgctcgctgcttaccaagagggtagccgcaccccaggatggatcccccagagtccccgcatcagagacttctcctgggcctcccccaatggggcctccacctccttcaagtaaggctcccaggtccccacctgtggggagtggtcctgcctctggcgtggagcccacaagtttcccagtcgagtctgaggctcgactgatggaggatgtgctgagacctttggaacaggcattggaagactgccgtggccacacaaggaagcaggtatgtgatgacatcagccgacgcctggcactgctgcaggaacagtgggctggaggaaagttgtcaatacctgtaaagaagagaatggctctactggtgcaagagctttcaagccaccggtgggacgcagcagatgacatccaccgctccctcatggttgaccatgtgactgaggtcagtcagtggatggtaggagttaaaagattaattgcagaaaagaggagtctgttttcagaggaggcagccaatgaagagaaatctgcagccacagctgagaagaaccataccataccaggcttccagcaggcttcataatcctcggttccccagactcaccggacaccatctcctatgccttggagaccttctgtcacttggctcccttcttaccaccaccaagactgtcccactgggcctgacccacctatgagggaagaagtcccacctgggccagagggagttcatgtgttactcataacatgcatttcaataaaaacatctctgcggtggg

SEQ ID NO: 286479 - DNA, 1330 bp, Homo sapiens
gcccccgggtgtcgatcggccgagggtacgtgaagcgggcaacaaggaacgcggctggaacgacccgccgcagttctcatacgggctgcagacccaggccggcggacccaggcgctcgctgcttaccaagagggtagccgcaccccaggatggatcccccagagtccccgcatcagagacttctcctgggcctcccccaatggggcctccacctccttcaagtaaggctcccaggtccccacctgtggggagtggtcctgcctctggcgtggagcccacaagtttcccagtcgagtctgaggctcgactgatggaggatgtgctgagacctttggaacaggcattggaagactgccgtggccacacaaggaagcaggtatgtgatgacatcagccgacgcctggcactgctgcaggaacagtgggctggaggaaagttgtcaatacctgtaaagaagagaatggctctactggtgcaagagctttcaagccaccggtgggacgcagcagatgacatccaccgctccctcatggttgaccatgtgactgaggtcagtcagtggatggtaggagttaaaagattaattgcagaaaagaggagtctgttttcagaggaggcagccaatgaagagaaatctgcagccacagctgagaagaaccataccataccaggcttccagcaggcttcataatcctcggttccccagactcaccggacaccatctcctatgccttggagaccttctgtcacttggctcccttcttaccaccaccaagactgtcccactgggcctgacccacctatgagggaagaagtcccacctgggccagagggagttcatgtgttactcataacatgcatttcaataaaaacatctctgcggtgggccttgggtaggagagatgaacccttccggtgccaagctagtcccctctggtgtcctcgactgccctgctccctgtgtatctgcaaacctctgttctcccttctccattcatcaggaagggatctgctgggtaaagtcagactactgcctaccactttttcccaaagtagactgaaagcacatcctgtgctgggcggagcagctgtgtttggatggtttcatttcagcatgagaacagactcaaatagaacggggagacttttccctcaacaaaaggaaagacagtcctatttgcactgtatcacccttgagatactactgttacagagattagaaccacattgagtggggttttctgtgtaaatcgaaggagaaaaagaccagattactgagattggggattgtaactctgacttgccaaacaaactgctgcctcattttggg

SEQ ID NO: 286480 - DNA, 439 bp, Homo sapiens
gaggatcttggaaggcatcctggtggtgatgagctttcaagccaccggtgggacgcagcagatgacatccaccgctccctcatggttgaccatgtgactgaggtcagtcagtggatggtaggagttaaaagattaattgcagaaaagaggagtctgttttcagaggaggcagccaatgaagagaaatctgcagccacagctgagaagaaccataccataccaggcttccagcaggcttcataatcctcggttccccagactcaccggacaccatctcctatgccttggagaccttctgtcacttggctcccttcttaccaccaccaagactgtcccactgggcctgacccacctatgagggaagaagtcccacctgggccagagggagttcatgtgttactcataacatgcatttcaataaaaacatctctgcggtggg

SEQ ID NO: 286481 - DNA, 1317 bp, Homo sapiens
tggggcaggagcttctttgtttgaatttgctcctgagaggatgaggcctcctagagcactggctcctggacagcaacctcctttggtgccttgtgaccagggccctgatggttcattagatggagccttcgagtcttagggagttgccgcagggtccccacagcggctcccgacggttgtgaaccagcatccatcctccacggattccggcaacccgcctggccctggacgtgtctcaactggcccgcgtgaggggccgccccggaaatgacgcgctgccccgctggccaagcggaagtggagatggcggagctgtacgtgaagccgggtgagcgcagccggcgggctagggcactaggttgtcgccccggcctaggctgggggcggttgcggcgcttagtatggaccctctgtctcccccagccccagtataagctaacagtggagttccgggctcgcttcacacatccctcgcctccgcaggcaacaaggaacgcggctggaacgacccgccgcagttctcatacgggctgcagacccaggccggcggacccaggcgctcgctgcttaccaagagggtagccgcaccccaggatggatcccccagagtccccgcatcagagacttctcctgggcctcccccaatggggcctccacctccttcaagtaaggctcccaggtccccacctgtggggagtggtcctgcctctggcgtggagcccacaagtttcccagtcgagtctgaggctcgactgatggaggatgtgctgagacctttggaacaggcattggaagactgccgtggccacacaaggaagcaggtatgtgatgacatcagccgacgcctggcactgctgcaggaacagtgggctggaggaaagttgtcaatacctgtaaagaagagaatggctctactggtgcaagagctttcaagccaccggtgggacgcagcagatgacatccaccgctccctcatggttgaccatgtgactgaggaactaagttttaatggcaaacctacagcttacttaagatatccctccagagagagagcaaggcaattgtacctgacacagcattgacaccaaatgaccagattccactgtgtccaacgggagcgacaaaactggtccccgccggggcttgtgcaacagaccctccttgccgaattcgggccagtctctctgttccaattgggggaggtatctttcgatcttgactggcactgactccttttggttggcccaacgttggtggggcagaagtggctgaaagaggtgaagatgatcccgaagaaacagatggaataggagagtc

SEQ ID NO: 286482 - DNA, 956 bp, Homo sapiens
tggggcaggagcttctttgtttgaatttgctcctgagaggatgaggcctcctagagcactggctcctggacagcaacctcctttggtgccttgtgaccagggccctgatggttcattagatggagccttcgagtcttagggagttgccgcagggtccccacagcggctcccgacggttgtgaaccagcatccatcctccacggattccggcaacccgcctggccctggacgtgtctcaactggcccgcgtgaggggccgccccggaaatgacgcgctgccccgctggccaagcggaagtggagatggcggagctgtacgtgaagccgggcaacaaggaacgcggctggaacgacccgccgcagttctcatacgggctgcagacccaggccggcggacccaggcgctcgctgcttaccaagagggtagccgcaccccaggatggatcccccagagaagcaggtatgtgatgacatcagccgacgcctggcactgctgcaggaacagtgggctggaggaaagttgtcaatacctgtaaagaagagaatggctctactggtgcaagagctttcaagccaccggtgggacgcagcagatgacatccaccgctccctcatggttgaccatgtgactgaggaactaagttttaatggcaaacctacagcttacttaagatatccctccagagagagagcaaggcaattgtacctgacacagcattgacaccaaatgaccagattccactgtgtccaacgggagcgacaaaactggtccccgccggggcttgtgcaacagaccctccttgccgaattcgggccagtctctctgttccaattgggggaggtatctttcgatcttgactggcactgactccttttggttggcccaacgttggtggggcagaagtggctgaaagaggtgaagatgatcccgaagaaacagatggaataggagagtc

SEQ ID NO: 286483 - DNA, 314 bp, Homo sapiens
attacaggtgtgagccatcacacccggccacctggtttacttttctaatctttagtgcctagcatattgtctggcgtagagtggggacttcataaatgcatatttttgaatgaataagttgtctcagagagtagcccttcttagaaggggtgaatttagagttaagcttcttacccatttaagccatgttgcttgatcctgctgtaccttttcagtccccgcatcagagacttctcctgggcctcccccaatggggcctccacctccttcaagtaaggctcccaggtccccacctgtggggagtggtcctgcct

SEQ ID NO: 286484 - DNA, 3054 bp, Homo sapiens
gcttcatatcccactacagtagctttttggacagaagctggtggtgggttttttgttttgttttgtattttttagctgccatcattaaaactcactaccttttttttttcctctgcacaggctgctttgattatgcaggttctacaactgactgcagaccagattgccatgttgcctcctgagcaaaggcagagtatcctgattttaaaggaacaaatacagaaatccactggagcaccttgataggttttcaaaaatacctggcaagaaatctggaaattctataattttgttgaaatattgaaaaaagatgacctgcatcctaacccttgaatgactcaaatcagtgccaggtggaggactcccatcaccttctctcagaacaaaatcacttcattttattgtcttagtttgtatattttctgtgacttgaaataaactttgaacacaattttagtacactgcaaattgatacacatgacctttttgcttttaaaaagcttaacactaagggtgaaaccttagatgtgttttctacccttactgcagtattgtactttaacatattgccatagttttgtttttaagttaaccacttattcttcttgatgatatttgagaatttctcagaagcaatgttttctggaacttggtttttgtttagtttgcttccagtaagaattattataaggctttgccctctgaaaatattctagcacttcggagtcttctaggagaaaatatcacatgcttagagctataaaatggtcagaaggctaacagagcaaagagcctagcacagctgtgtgtttagtttagaaaaatccaaatatcaaaatgcatttgtttcaatagcaggtctgaacatgtataattcagagttaagacaaaaattgttttagcactggtttgagtgtgtcagcaacacaagagactgttgacatttacttgtgtgttcttaaacttatcagtctaggcagtcaactttgaaagtttaaaaagccactgatttttcacatgctcaagatgaaataaaaacagaaatcaaatgaacaaaatacatttcatcctatcttccaggcagtccctaacctgcagccctaccctgtaactacgtttattctgggaacttacaacacagaaaaccctaaaacttgtacattcttctcattttaagtggaccaaatgtagagcacagtcagattgctcattaggtctgctcctgcctgcttccttgcggataggtatgaacataattagtgccattagctctaatctatgggtcttattgcctagtatttctctctctcgccgcgccgccgcctcctcctctccccccaccccaaccccatctctctcgtagtggcattaaggaggaacatggtttctctctatcaggccaacctcaagaggttaagagttgccttaataatcagtaaagttctactggaactacttttgagccaatttatattcttggaattctatcccctgggttaggattatggtcaggtgaattaaaagcctggcataggcttagagaatgtaatagcatattgcttacatgtcaagcaaaagaatgcaaagataatcaactttttgagtgacaatgaaattgagggattttctactcatataaacatttataagaaatttgttgattaaggtatttcatattacaactttgcaagaaaaacttgctcaaagcaggtgaggagctttctgtgtatcctgctcatccccagttcaacttggatgttggctatgcataggatttattatattcattaccatgaatataatcacgaatttatgcctactcccataaatattcaagccttgggatattgattttggcagccatcatatcttgaagtgagtgtgtcaatatatttagacatggagaccaagagtgatgcctttctcattaggaactcgttgtaagtttcaagattccaaatcaaggtcattgaagatgaagttgtcatttggtcagtagttgtctaataagaatcatgtcttcaaggtttcattgtgcattttcccaaagccttattaaacctgaattagctgaaatccgggtgaacaaattggcaacagcagtggtatccctccctatgtaaacaaccatcagtattgttttactgttgtaataaatgaaacatgattagccaccatgagttcatgacctacctttattgtgctcagactagtgacaaaaaaaaaccaaaaacagttttatccctcaagccgtagaggttcctaaactattagaaacaaccatttgttcattcgtggtcacttaatggtagaaaaaatagataatataatgctaattcagtacaaccattcttctaatctataatgagttgaattgtctgggcacaatgaagtgtgaggtttctctcttaagagccctgggcttctctccttctagggattcactgtgacgactaacatcccagagccagtgtggtccttgtaggccgaggttgggtagatggcagaaataaaaagcattctgatagagaatgaaggcattttgcttatgttattagctgaatgattccttagcgatataggtaggagtccacaaaaatctatgaaaattataaattgttattttttaaactagacattaataaactcccttaatagtgataaagagctcctcttgactaaataagtcatcctaacatggagttcaagttttcacaatcgcttttaacagaataatacaagatgacagtatagctgacttgcaattataatacaatttcaattacaatgagcatactttctagattttctttcccaaatggagagcccaaaaagaagtaacaaaagactcattcatcaagtgaagaagaaaatcctttattttttgatgagcaaaaataataaattgctgttcacactggataagaccatatcaaaagtgacagtaaacatgtacactgttggtgttatatggggatggggttctcggtaattttgtttattatttatgtttattattatgttttatcattaattattcaataaatttttatt

SEQ ID NO: 286485 - DNA, 1983 bp, Homo sapiens
gcaccggaagccgactcaacagagctatggcgggtttgactgtgagagacccagcggtggatcgttctctacgttctgtgttcgtggggaacattccttatgaagctactgaagagcagttgaaggacatcttttctgaggttggacctgttgttagtttcagattggtatacgatagagagacaggaaagccaaagggttatggcttctgtgaataccaagaccaagagacagcacttagtgccatgcggaacctgaatgggcgcgaattcagtgggagagcacttcgagtggacaatgctgccagtgaaaagaacaaagaagagctgaagagccttggcactggtgcccctgtcattgagtcaccttatggagagaccatcagtcctgaggatgcccctgagtccattagcaaagcagttgccagccttccaccagagcagatgtttgagctgatgaaacaaatgaagctctgtgtccagaatagtccccaggaggcacggaacatgttacttcagaaccctcaactggcttatgctttgctgcaagcacaggtagtgatgagaattgtggatccggaaattgccctgaaaattctgcatcgccagacaaatatcccaacgctgattgcaggcaaccctcagccagtccatggtgctgggcctggctcaggatccaatgtgtcaatgaaccagcagaatcctcaggcccctcaggcccagtctttgggtggaatgcatgtcaatggcgcacctcctctgatgcaagcttctatgcagggtggagttccagcaccagggcaaatgccagctgctgtcacaggacctggccctggttccttagctcctggaggaggaatgcaggctcaggttggaatgccaggaagtggaccagtgtccatggaacgggggcaagtgccgatgcaagaccccagagcagctatgcagcggggatccttgcctgcgaatgtcccaacccctcgaggcttgttaggagatgctccgaatgatccacggggaggcactttactttctgtaactggagaggtagagcctagaggttacttgggaccacctcatcagggtccacccatgcaccatgtccctggccatgagagccgaggaccacccccacatgaactgaggggagggccattacccgagcccagacctctaatggcagaaccaagaggacccatgctagatcagaggggtccacccttggatggcagaggtggaagggatccccgaggaatagatgcacgagggatggaggcccgagccatggaggcaagagggttagatgccagaggattagaggcccgtgcaatggaggcccgtgcgatggaagctcgtgcaatggaggcccgagcgatggaggcccgtgcaatggaagtccgagggatggaggccagaggcatggataccagaggcccagtgcctggccccagaggacctatacctagtggaatgcagggtcccagtccaattaacatgggggcggttgtcccccagggatccagacaggtcccagtcatgcagggaacaggaatgcaaggagcaagtatacagggtggaagccagcctggcggctttagtcccgggcagaaccaagtcactccacaggatcatgagaaggctgctttgattatgcaggttctacaactgactgcagaccagattgccatgttgcctcctgagcaaaggcagagtatcctgattttaaaggaacaaatacagaaatccactggagcaccttgataggttttcaaaaatacctggcaagaaatctggaaattctataattttgttgaaatattgaaaaaagatgacctgcatcctaacccttgaatgactcaaatcagtgccaggtggaggactcccatcaccttctctcagaacaaaatcacttcattttattgtcttagtttgtatattttctgtgacttgaaataaactttgaacacaattttagtacactgca

SEQ ID NO: 286486 - DNA, 466 bp, Homo sapiens
gcttcatatcccactacagtagctttttggacagaagctggtggtgggttttttgttttgttttgtattttttagctgccatcattaaaactcactaccttttttttttcctctgcacaggctgctttgattatgcaggttctacaactgactgcagaccagattgccatgttgcctcctgagcaaaggcagagtatcctgattttaaaggaacaaatacagaaatccactggagcaccttgataggttttcaaaaatacctggcaagaaatctggaaattctataattttgttgaaatattgaaaaaagatgacctgcatcctaacccttgaatgactcaaatcagtgccaggtggaggactcccatcaccttctctcagaacaaaatcacttcattttattgtcttagtttgtatattttctgtgacttgaaataaactttgaacacaattttagtacactgca

SEQ ID NO: 286487 - DNA, 4571 bp, Homo sapiens
gcaccggaagccgactcaacagagctatggcgggtttgactgtgagagacccagcggtggatcgttctctacgttctgtgttcgtggggaacattccttatgaagctactgaagagcagttgaaggacatcttttctgaggttggacctgttgttagtttcagattggtatacgatagagagacaggaaagccaaagggttatggcttctgtgaataccaagaccaagagacagcacttagtgccatgcggaacctgaatgggcgcgaattcagtgggagagcacttcgagtggacaatgctgccagtgaaaagaacaaagaagagctgaagagccttggcactggtgcccctgtcattgagtcaccttatggagagaccatcagtcctgaggatgcccctgagtccattagcaaagcagttgccagccttccaccagagcagatgtttgagctgatgaaacaaatgaagctctgtgtccagaatagtccccaggaggcacggaacatgttacttcagaaccctcaactggcttatgctttgctgcaagcacaggtagtgatgagaattgtggatccggaaattgccctgaaaattctgcatcgccagacaaatatcccaacgctgattgcaggcaaccctcagccagtccatggtgctgggcctggctcaggatccaatgtgtcaatgaaccagcagaatcctcaggcccctcaggcccagtctttgggtggaatgcatgtcaatggcgcacctcctctgatgcaagcttctatgcagggtggagttccagcaccagggcaaatgccagctgctgtcacaggacctggccctggttccttagctcctggaggaggaatgcaggctcaggttggaatgccaggaagtggaccagtgtccatggaacgggggcaagtgccgatgcaagaccccagagcagctatgcagcggggatccttgcctgcgaatgtcccaacccctcgaggcttgttaggagatgctccgaatgatccacggggaggcactttactttctgtaactggagaggtagagcctagaggttacttgggaccacctcatcagggtccacccatgcaccatgtccctggccatgagagccgaggaccacccccacatgaactgaggggagggccattacccgagcccagacctctaatggcagaaccaagaggacccatgctagatcagaggggtccacccttggatggcagaggtggaagggatccccgaggaatagatgcacgagggatggaggcccgagccatggaggcaagagggttagatgccagaggattagaggcccgtgcaatggaggcccgtgcgatggaagctcgtgcaatggaggcccgagcgatggaggcccgtgcaatggaagtccgagggatggaggccagaggcatggataccagaggcccagtgcctggccccagaggacctatacctagtggaatgcagggtcccagtccaattaacatgggggcggttgtcccccagggatccagacaggtcccagtcatgcagggaacaggaatgcaaggagcaagtatacagggtggaagccagcctggcggctttagtcccgggcagaaccaagtcactccacaggatcatgagaaggctgctttgattatgcaggttctacaactgactgcagaccagattgccatgttgcctcctgagcaaaggcagagtatcctgattttaaaggaacaaatacagaaatccactggagcaccttgataggttttcaaaaatacctggcaagaaatctggaaattctataattttgttgaaatattgaaaaaagatgacctgcatcctaacccttgaatgactcaaatcagtgccaggtggaggactcccatcaccttctctcagaacaaaatcacttcattttattgtcttagtttgtatattttctgtgacttgaaataaactttgaacacaattttagtacactgcaaattgatacacatgacctttttgcttttaaaaagcttaacactaagggtgaaaccttagatgtgttttctacccttactgcagtattgtactttaacatattgccatagttttgtttttaagttaaccacttattcttcttgatgatatttgagaatttctcagaagcaatgttttctggaacttggtttttgtttagtttgcttccagtaagaattattataaggctttgccctctgaaaatattctagcacttcggagtcttctaggagaaaatatcacatgcttagagctataaaatggtcagaaggctaacagagcaaagagcctagcacagctgtgtgtttagtttagaaaaatccaaatatcaaaatgcatttgtttcaatagcaggtctgaacatgtataattcagagttaagacaaaaattgttttagcactggtttgagtgtgtcagcaacacaagagactgttgacatttacttgtgtgttcttaaacttatcagtctaggcagtcaactttgaaagtttaaaaagccactgatttttcacatgctcaagatgaaataaaaacagaaatcaaatgaacaaaatacatttcatcctatcttccaggcagtccctaacctgcagccctaccctgtaactacgtttattctgggaacttacaacacagaaaaccctaaaacttgtacattcttctcattttaagtggaccaaatgtagagcacagtcagattgctcattaggtctgctcctgcctgcttccttgcggataggtatgaacataattagtgccattagctctaatctatgggtcttattgcctagtatttctctctctcgccgcgccgccgcctcctcctctccccccaccccaaccccatctctctcgtagtggcattaaggaggaacatggtttctctctatcaggccaacctcaagaggttaagagttgccttaataatcagtaaagttctactggaactacttttgagccaatttatattcttggaattctatcccctgggttaggattatggtcaggtgaattaaaagcctggcataggcttagagaatgtaatagcatattgcttacatgtcaagcaaaagaatgcaaagataatcaactttttgagtgacaatgaaattgagggattttctactcatataaacatttataagaaatttgttgattaaggtatttcatattacaactttgcaagaaaaacttgctcaaagcaggtgaggagctttctgtgtatcctgctcatccccagttcaacttggatgttggctatgcataggatttattatattcattaccatgaatataatcacgaatttatgcctactcccataaatattcaagccttgggatattgattttggcagccatcatatcttgaagtgagtgtgtcaatatatttagacatggagaccaagagtgatgcctttctcattaggaactcgttgtaagtttcaagattccaaatcaaggtcattgaagatgaagttgtcatttggtcagtagttgtctaataagaatcatgtcttcaaggtttcattgtgcattttcccaaagccttattaaacctgaattagctgaaatccgggtgaacaaattggcaacagcagtggtatccctccctatgtaaacaaccatcagtattgttttactgttgtaataaatgaaacatgattagccaccatgagttcatgacctacctttattgtgctcagactagtgacaaaaaaaaaccaaaaacagttttatccctcaagccgtagaggttcctaaactattagaaacaaccatttgttcattcgtggtcacttaatggtagaaaaaatagataatataatgctaattcagtacaaccattcttctaatctataatgagttgaattgtctgggcacaatgaagtgtgaggtttctctcttaagagccctgggcttctctccttctagggattcactgtgacgactaacatcccagagccagtgtggtccttgtaggccgaggttgggtagatggcagaaataaaaagcattctgatagagaatgaaggcattttgcttatgttattagctgaatgattccttagcgatataggtaggagtccacaaaaatctatgaaaattataaattgttattttttaaactagacattaataaactcccttaatagtgataaagagctcctcttgactaaataagtcatcctaacatggagttcaagttttcacaatcgcttttaacagaataatacaagatgacagtatagctgacttgcaattataatacaatttcaattacaatgagcatactttctagattttctttcccaaatggagagcccaaaaagaagtaacaaaagactcattcatcaagtgaagaagaaaatcctttattttttgatgagcaaaaataataaattgctgttcacactggataagaccatatcaaaagtgacagtaaacatgtacactgttggtgttatatggggatggggttctcggtaattttgtttattatttatgtttattattatgttttatcattaattattcaataaatttttatt

SEQ ID NO: 286488 - DNA, 2650 bp, Homo sapiens
gcaccggaagccgactcaacagagctatggcgggtttgactgtgagagacccagcggtggatcgttctctacgttctgtgttcgtggggaacattccttatgaagctactgaagagcagttgaaggacatcttttctgaggttggacctgttgttagtttcagattggtatacgatagagagacaggaaagccaaagggttatggcttctgtgaataccaagaccaagagacagcacttagtgccatgcggaacctgaatgggcgcgaattcagtgggagagcacttcgagtggacaatgctgccagtgaaaagaacaaagaagagctgaagagccttggcactggtgcccctgtcattgagtcaccttatggagagaccatcagtcctgaggatgcccctgagtccattagcaaagcagttgccagccttccaccagagcagatgtttgagctgatgaaacaaatgaagctctgtgtccagaatagtccccaggaggcacggaacatgttacttcagaaccctcaactggcttatgctttgctgcaagcacaggtagtgatgagaattgtggatccggaaattgccctgaaaattctgcatcgccagacaaatatcccaacgctgattgcaggcaaccctcagccagtccatggtgctgggcctggctcaggatccaatgtgtcaatgaaccagcagaatcctcaggcccctcaggcccagtctttgggtggaatgcatgtcaatggcgcacctcctctgatgcaagcttctatgcagggtggagttccagcaccagggcaaatgccagctgctgtcacaggacctggccctggttccttagctcctggaggaggaatgcaggctcaggttggaatgccaggaagtggaccagtgtccatggaacgggggcaagtgccgatgcaagaccccagagcagctatgcagcggggatccttgcctgcgaatgtcccaacccctcgaggcttgttaggagatgctccgaatgatccacggggaggcactttactttctgtaactggagaggtagagcctagaggttacttgggaccacctcatcagggtccacccatgcaccatgtccctggccatgagagccgaggaccacccccacatgaactgaggggagggccattacccgagcccagacctctaatggcagaaccaagaggacccatgctagatcagaggggtccacccttggatggcagaggtggaagggatccccgaggaatagatgcacgagggatggaggcccgagccatggaggcaagagggttagatgccagaggattagaggcccgtgcaatggaggcccgtgcgatggaagctcgtgcaatggaggcccgagcgatggaggcccgtgcaatggaagtccgagggatggaggccagaggcatggataccagaggcccagtgcctggccccagaggacctatacctagtggaatgcagggtcccagtccaattaacatgggggcggttgtcccccagggatccagacaggtcccagtcatgcagggaacaggaatgcaaggagcaagtatacagggtggaagccagcctggcggctttagtcccgggcagaaccaagtcactccacaggatcatgagaaggctgctttgattatgcaggttctacaactgactgcagaccagattgccatgttgcctcctgagcaaaggcagagtatcctgattttaaaggaacaaatacagaaatccactggagcaccttgataggtgagcaaacttaatccccatctgagtaggactagctccttgtctattctgggtatatacttttaaccttaaccaacaagattgttctctcagcggccctcaatccactcagctagactcttctttacccttcagtaggtcagctcctgtagggatagagtaaggctatacaatgtttgttcagttgttgaattgcttataatctttcctaatgacaaaggtaatgtatgatcagtttaacaaaagtaatcatatacagaaatgtagaaggtgaaaggtaaaaagccctgtttcctcaatctcattccccagacaaaacctctaaatatagtttggtgtgtatccttctacaatcaattgtattattttattccaaactgtcctgtcaaaatggaaaaatacaaagcatttcaataaaatgtgtaaatattttgtttcttgtatttattttatagggaatattttgatgttgaactatagtagcacataatttaaggtagtaaatgtccgtcatcaccatcagtttctatatattttggagatcgctgtaccccgctacccttatttttcttgctcatcatttaggcagaaagaatccaggggccaagcacagtggctgagccctgtaatctcagctttggcaggctgaggtggaaggattacttgagaccaggagttcaagaccagcctaagcaacatagtgagaccccatctttacaaaaattttttaaaaaattagccaggcatggtgagatgcgcctatagttccagctacttgtgaggccgaggtgggaggactggttgagtccaggaggtcagggctgcagtaagccatgattatgccactgcactctagcctgggtcacagagtgagactctgtgtcaaa

SEQ ID NO: 286489 - DNA, 4605 bp, Homo sapiens
atctcatgaatcgctaccggagccgctgacggttcggacgtgcagttctccctgcttatcctgtagggcgtccaacctggtggactcatgagcaaagagatattcccattctgccgagtggggaacattccttatgaagctactgaagagcagttgaaggacatcttttctgaggttggacctgttgttagtttcagattggtatacgatagagagacaggaaagccaaagggttatggcttctgtgaataccaagaccaagagacagcacttagtgccatgcggaacctgaatgggcgcgaattcagtgggagagcacttcgagtggacaatgctgccagtgaaaagaacaaagaagagctgaagagccttggcactggtgcccctgtcattgagtcaccttatggagagaccatcagtcctgaggatgcccctgagtccattagcaaagcagttgccagccttccaccagagcagatgtttgagctgatgaaacaaatgaagctctgtgtccagaatagtccccaggaggcacggaacatgttacttcagaaccctcaactggcttatgctttgctgcaagcacaggtagtgatgagaattgtggatccggaaattgccctgaaaattctgcatcgccagacaaatatcccaacgctgattgcaggcaaccctcagccagtccatggtgctgggcctggctcaggatccaatgtgtcaatgaaccagcagaatcctcaggcccctcaggcccagtctttgggtggaatgcatgtcaatggcgcacctcctctgatgcaagcttctatgcagggtggagttccagcaccagggcaaatgccagctgctgtcacaggacctggccctggttccttagctcctggaggaggaatgcaggctcaggttggaatgccaggaagtggaccagtgtccatggaacgggggcaagtgccgatgcaagaccccagagcagctatgcagcggggatccttgcctgcgaatgtcccaacccctcgaggcttgttaggagatgctccgaatgatccacggggaggcactttactttctgtaactggagaggtagagcctagaggttacttgggaccacctcatcagggtccacccatgcaccatgtccctggccatgagagccgaggaccacccccacatgaactgaggggagggccattacccgagcccagacctctaatggcagaaccaagaggacccatgctagatcagaggggtccacccttggatggcagaggtggaagggatccccgaggaatagatgcacgagggatggaggcccgagccatggaggcaagagggttagatgccagaggattagaggcccgtgcaatggaggcccgtgcgatggaagctcgtgcaatggaggcccgagcgatggaggcccgtgcaatggaagtccgagggatggaggccagaggcatggataccagaggcccagtgcctggccccagaggacctatacctagtggaatgcagggtcccagtccaattaacatgggggcggttgtcccccagggatccagacaggtcccagtcatgcagggaacaggaatgcaaggagcaagtatacagggtggaagccagcctggcggctttagtcccgggcagaaccaagtcactccacaggatcatgagaaggctgctttgattatgcaggttctacaactgactgcagaccagattgccatgttgcctcctgagcaaaggcagagtatcctgattttaaaggaacaaatacagaaatccactggagcaccttgataggttttcaaaaatacctggcaagaaatctggaaattctataattttgttgaaatattgaaaaaagatgacctgcatcctaacccttgaatgactcaaatcagtgccaggtggaggactcccatcaccttctctcagaacaaaatcacttcattttattgtcttagtttgtatattttctgtgacttgaaataaactttgaacacaattttagtacactgcaaattgatacacatgacctttttgcttttaaaaagcttaacactaagggtgaaaccttagatgtgttttctacccttactgcagtattgtactttaacatattgccatagttttgtttttaagttaaccacttattcttcttgatgatatttgagaatttctcagaagcaatgttttctggaacttggtttttgtttagtttgcttccagtaagaattattataaggctttgccctctgaaaatattctagcacttcggagtcttctaggagaaaatatcacatgcttagagctataaaatggtcagaaggctaacagagcaaagagcctagcacagctgtgtgtttagtttagaaaaatccaaatatcaaaatgcatttgtttcaatagcaggtctgaacatgtataattcagagttaagacaaaaattgttttagcactggtttgagtgtgtcagcaacacaagagactgttgacatttacttgtgtgttcttaaacttatcagtctaggcagtcaactttgaaagtttaaaaagccactgatttttcacatgctcaagatgaaataaaaacagaaatcaaatgaacaaaatacatttcatcctatcttccaggcagtccctaacctgcagccctaccctgtaactacgtttattctgggaacttacaacacagaaaaccctaaaacttgtacattcttctcattttaagtggaccaaatgtagagcacagtcagattgctcattaggtctgctcctgcctgcttccttgcggataggtatgaacataattagtgccattagctctaatctatgggtcttattgcctagtatttctctctctcgccgcgccgccgcctcctcctctccccccaccccaaccccatctctctcgtagtggcattaaggaggaacatggtttctctctatcaggccaacctcaagaggttaagagttgccttaataatcagtaaagttctactggaactacttttgagccaatttatattcttggaattctatcccctgggttaggattatggtcaggtgaattaaaagcctggcataggcttagagaatgtaatagcatattgcttacatgtcaagcaaaagaatgcaaagataatcaactttttgagtgacaatgaaattgagggattttctactcatataaacatttataagaaatttgttgattaaggtatttcatattacaactttgcaagaaaaacttgctcaaagcaggtgaggagctttctgtgtatcctgctcatccccagttcaacttggatgttggctatgcataggatttattatattcattaccatgaatataatcacgaatttatgcctactcccataaatattcaagccttgggatattgattttggcagccatcatatcttgaagtgagtgtgtcaatatatttagacatggagaccaagagtgatgcctttctcattaggaactcgttgtaagtttcaagattccaaatcaaggtcattgaagatgaagttgtcatttggtcagtagttgtctaataagaatcatgtcttcaaggtttcattgtgcattttcccaaagccttattaaacctgaattagctgaaatccgggtgaacaaattggcaacagcagtggtatccctccctatgtaaacaaccatcagtattgttttactgttgtaataaatgaaacatgattagccaccatgagttcatgacctacctttattgtgctcagactagtgacaaaaaaaaaccaaaaacagttttatccctcaagccgtagaggttcctaaactattagaaacaaccatttgttcattcgtggtcacttaatggtagaaaaaatagataatataatgctaattcagtacaaccattcttctaatctataatgagttgaattgtctgggcacaatgaagtgtgaggtttctctcttaagagccctgggcttctctccttctagggattcactgtgacgactaacatcccagagccagtgtggtccttgtaggccgaggttgggtagatggcagaaataaaaagcattctgatagagaatgaaggcattttgcttatgttattagctgaatgattccttagcgatataggtaggagtccacaaaaatctatgaaaattataaattgttattttttaaactagacattaataaactcccttaatagtgataaagagctcctcttgactaaataagtcatcctaacatggagttcaagttttcacaatcgcttttaacagaataatacaagatgacagtatagctgacttgcaattataatacaatttcaattacaatgagcatactttctagattttctttcccaaatggagagcccaaaaagaagtaacaaaagactcattcatcaagtgaagaagaaaatcctttattttttgatgagcaaaaataataaattgctgttcacactggataagaccatatcaaaagtgacagtaaacatgtacactgttggtgttatatggggatggggttctcggtaattttgtttattatttatgtttattattatgttttatcattaattattcaataaatttttatt

SEQ ID NO: 286490 - DNA, 927 bp, Homo sapiens
gcaccggaagccgactcaacagagctatggcgggtttgactgtgagagacccagcggtggatcgttctctacgttctgtgttcgtggggaacattccttatgaagctactgaagagcagttgaaggacatcttttctgaggttggacctgttgttagtttcagattggtatacgatagagagacaggaaagccaaagggttatggcttctgtgaataccaagaccaagagacagcacttagtgccatgcggaacctgaatgggcgcgaattcagtgggagagcacttcgagtggacaatgctgccagtgaaaagaacaaagaagagctgaagagccttggcactggtgcccctgtcattgagtcaccttatggagagaccatcagtcctgaggatgcccctgagtccattagcaaagcagttgccagccttccaccagagcagatgtttgagctgatgaaacaaatgaaggtcccagtcatgcagggaacaggaatgcaaggagcaagtatacagggtggaagccagcctggcggctttagtcccgggcagaaccaagtcactccacaggatcatgagaaggctgctttgattatgcaggttctacaactgactgcagaccagattgccatgttgcctcctgagcaaaggcagagtatcctgattttaaaggaacaaatacagaaatccactggagcaccttgataggttttcaaaaatacctggcaagaaatctggaaattctataattttgttgaaatattgaaaaaagatgacctgcatcctaacccttgaatgactcaaatcagtgccaggtggaggactcccatcaccttctctcagaacaaaatcacttcattttattgtcttagtttgtatattttctgtgacttgaaataaactttgaacacaattttagtacactgca

SEQ ID NO: 286491 - DNA, 1990 bp, Homo sapiens
gcaccggaagccgactcaacagagctatggcgggtttgactgtgagagacccagcggtggatcgttctctacgttctgtgttcgtggggaacattccttatgaagctactgaagagcagttgaaggacatcttttctgaggttggacctgttgttagtttcagattggtatacgatagagagacaggaaagccaaagggttatggcttctgtgaataccaagaccaagagacagcacttagtgccatgcggaacctgaatgggcgcgaattcagtgggagagcacttcgagtggacaatgctgccagtgaaaagaacaaagaagagctgaagagccttggcactggtgcccctgtcattgagtcaccttatggagagaccatcagtcctgaggatgcccctgagtccattagcaaagcagttgccagccttccaccagagcagatgtttgagctgatgaaacaaatgaagctctgtgtccagaatagtccccaggaggcacggaacatgttacttcagaaccctcaactggcttatgctttgctgcaagcacaggtagtgatgagaattgtggatccggaaattgccctgccagtccatggtgctgggcctggctcaggatccaatgtgtcaatgaaccagcagaatcctcaggcccctcaggcccagtctttggcccgtgcgatggaagctcgtgcaatggaggcccgagcgatggaggcccgtgcaatggaagtccgagggatggaggccagaggcatggataccagaggcccagtgcctggccccagaggacctatacctagtggaatgcagggtcccagtccaattaacatgggggcggttgtcccccagggatccagacaggtcccagtcatgcagggaacaggaatgcaaggagcaagtatacagggtggaagccagcctggcggctttagtcccgggcagaaccaagtcactccacaggatcatgagaaggctgctttgattatgcaggttctacaactgactgcagaccagattgccatgttgcctcctgagcaaaggcagagtatcctgattttaaaggaacaaatacagaaatccactggagcaccttgataggtgagcaaacttaatccccatctgagtaggactagctccttgtctattctgggtatatacttttaaccttaaccaacaagattgttctctcagcggccctcaatccactcagctagactcttctttacccttcagtaggtcagctcctgtagggatagagtaaggctatacaatgtttgttcagttgttgaattgcttataatctttcctaatgacaaaggtaatgtatgatcagtttaacaaaagtaatcatatacagaaatgtagaaggtgaaaggtaaaaagccctgtttcctcaatctcattccccagacaaaacctctaaatatagtttggtgtgtatccttctacaatcaattgtattattttattccaaactgtcctgtcaaaatggaaaaatacaaagcatttcaataaaatgtgtaaatattttgtttcttgtatttattttatagggaatattttgatgttgaactatagtagcacataatttaaggtagtaaatgtccgtcatcaccatcagtttctatatattttggagatcgctgtaccccgctacccttatttttcttgctcatcatttaggcagaaagaatccaggggccaagcacagtggctgagccctgtaatctcagctttggcaggctgaggtggaaggattacttgagaccaggagttcaagaccagcctaagcaacatagtgagaccccatctttacaaaaattttttaaaaaattagccaggcatggtgagatgcgcctatagttccagctacttgtgaggccgaggtgggaggactggttgagtccaggaggtcagggctgcagtaagccatgattatgccactgcactctagcctgggtcacagagtgagactctgtgtcaaa

SEQ ID NO: 286492 - DNA, 483 bp, Homo sapiens
aggccccggggcaaatggagggcggcgtgcgctgtgcttatcggcccctaacggggccggagccgaggctcatggtgcagggagattcgcccgccgccgccagcagctctgtcttggcattgcgctgcctacagcctacccggccgtcaccgaacgcgggagcgccggggatctgggcggaggagccaggagaggcggggaggcacggggtgtgaagtgcggcctgtatagcaaccggcgcacggcgccttccgcgggttgtgacctttgaagagaaatgccgtagaagcatggacgtggcttttcaccaaggttattcactaatttaagtgttttttttaattttattttattttattttattttttgagacaggtactcactctgtctcccaggccggagtgcaattatctgtacaattgataatctataagatggtccaacctgcgtaacagagtgagattccgtctcaaaaaaaaaaaa

SEQ ID NO: 286493 - DNA, 449 bp, Homo sapiens
gtactccaaataccattatagctagtcaaacttcataaataaaactgaaagtcatagagagtcagagatggctactccttctggttctgaatgtatgtacctgtcaacaaaagaaagccatctccatgtttccagagtcatgatgaaatcacatttcaaagttgtttcaacaggtgccttatgtcaaatgcctcttcctataaaagaaactgctgagttgttctaaacagtgcatgaaaatagcaagtgggctgagtgagcaatcacagtgaggtcctgagcacggtgtaaaaaaccccagattcagattcagcttcctccagagagcggggttacctcccaccatgcttgagggacagccctcccataattagactctactcacagtctcagcctgaagtgtgactagcttaaactagtgactgtaggaattgagcccctgtagggag

SEQ ID NO: 286494 - DNA, 1149 bp, Homo sapiens
tagggtacagtatagatgaagtgccttcctatctaggtaatccaagcagtagaacttgtagaagagctcagattcctatgaaaagctcctacactagagctgataaatcagaaaattgggtcagtctaggaatattcaatatatatgtaaagtcttattttttgaaaagtattgatttttttaaagtttcattaatctgttgaatagatttcattaccttggagataactttactaatcttatgtctgtcagtcttaaaagcatttagtgaaatattctggtattcaaaagtaacccacaaagtatttttctcgtagggagtatttaaaaaagaggatgatattgatctgcttggtgaagagttcaggaaagtatatcaacaaaggagtgaaatttgtgaagagaaatgatatcatcaaaattgggtaaagcatagattttttgtatgttaccactagatgtcagcataacttttgttttacagttcagtggcattaggtatccattgtctgtttggattttgtaaatcatcactgaatttcataacttgtaaacaattatcagatacaaattaattttaatcaagctgttatttttgtactgataatttcaaaatccgatttctacaacactacagagcactgtttgcatccccatcctcaagacagtatatttaccttgactaatacagaactctaccccaaagtgaactgccttctgtctgtgtttacgaactttacttacttgatttagccagggaaataaatatttggaattttcttttaaagcatcttttttggtctactgtaagggaggagaattataaatgaaaagagtcaagaattttattatctgatgtgcttaattgtcacgctaagaacttaaaaaacaactcaaaaagagctaatagctaatctcctaaatctaaaaagggaattctttgaaattattttgctttcataatcaaatatattacttatgaagaataaaaataattcaaaccactacaataagtaaaatgggtatccatcacatactgtcatagagactaactgaagtagatcacttatgaatttccccattcaagtgctttcataaattcctcctcagtgaaagatagcatcttggcagcttcaatatgcatctgtt

SEQ ID NO: 286495 - DNA, 311 bp, Homo sapiens
tggaaaaacttattgaagagcgtcgccaacaattccttgcagacaaagtaagaaaaagttgtggggtttttttggtcattatcattaaacagcaatagctcatctatcatccactaaacatttactgagaagctttatatgccagacaatgttagtatgtttactaatatatatataaattttctgaccatttttgcttctagaaaatatttattgatgctttctatgtgctaaacactggttggtattgagaacataaaaggtaaataaaactaagtccatgtcacttatgaatttatggtcttggttaa

SEQ ID NO: 286496 - DNA, 338 bp, Homo sapiens
ccctaaaggcatccattaaatataatgaattatttctcctatggatctaaaataatacccgctgtattccctctttgagtaaattaaaaatacagttactcagttttctgtgaggttttcattctcttatggtcctaacatttaaatttgtttttgtttttttaaacagcattgagcttagagaattggagaagaaattaaaagcagcttacatgaataaagaaagggcagctcagattgctgaaaaggatgccattaaatatgaacaaatggtaatcatgtttctggtcattatgtttttagcttcatttagaaaataaaaattagacttgtttctt

SEQ ID NO: 286497 - DNA, 2392 bp, Homo sapiens
acttttggtcgagcggagggcgcgcagctccaccgttgccaagacgccgcgtaaacacccgagcgcgcgcagccaggtgcgctccttggggctgctggctgctgcgtttgcggcgggaggtggtggccgcggtcccacgagagggggtatttttcgtcagccaagatgggttccaaaaggagaaatttgagctgtagtgaaaggcatcagaaattagtagatgaaaactactgcaaaaaattacatgtccaagctctaaaaaacgtcaacagtcaaatcaggaatcaaatggtgcagaatgaaaatgataaccgtgttcagcgcaagcaatttctcagattattacaaaatgaacaatttgagttggatatggaagaggccattcaaaaggcagaagaaaacaagagattgaaagaactccagctcaaacaagaagaaaaactggctatggaattggcaaaactgaaacatgaaagtctaaaggacgaaaagatgaggcaacaagtaagagaaaacagcattgagcttagagaattggagaagaaattaaaagcagcttacatgaataaagaaagggcagctcagattgctgaaaaggatgccattaaatatgaacaaatgaaacgtgatgctgaaatagccaaaaccatgatggaagaacacaagagaataataaaggaagagaatgctgcagaagacaaacgaaacaaagcgaaagcacagtactatcttgacttagagaaacaacttgaagaacaagaaaaaaaaaagcaggaagcttatgagcagctgctaaaagagaaactcatgattgatgaaattgttaggaagatctatgaagaagatcagttggaaaaacaacaaaagttagaaaaaatgaatgcaatgcgaaggtatatagaagagtttcagaaagagcaggctctctggagaaaaaagaaacgtgaggagatggaagaagaaaacagaaaaatcatagagtttgctaacatgcagcagcaaagagaagaagatcggatggcaaaagttcaagaaaatgaggagaaaaggctacagcttcagaatgcgttgacacagaaattagaagaaatgctgcggcaacgtgaagatttggaacaagtgcgacaagaattataccaggaagaacaagctgaaatatataagagcaagctaaaagaagaagcagaaaagaaattgagaaagcaaaaagagatgaagcaagattttgaagaacaaatggccttgaaggaattagtgctacaggctgcaaaagaggaagaggagaactttagaaaaactatgctagctaaatttgctgaggatgatcgaatagaattaatgaatgctcagaaacaaagaatgaagcagctggaacacaggagggctgtggaaaaacttattgaagagcgtcgccaacaattccttgcagacaaacaacgtgaactagaagagtggcagttgcagcaaaggcggcaaggatttattaatgcaattattgaagaagaaaggctaaaacttcttaaagagcatgctacaaacttactaggctatctccctaaaggagtatttaaaaaagaggatgatattgatctgcttggtgaagagttcaggaaagtatatcaacaaaggagtgaaatttgtgaagagaaatgatatcatcaaaattgggtaaagcatagattttttgtatgttaccactagatgtcagcataacttttgttttacagttcagtggcattaggtatccattgtctgtttggattttgtaaatcatcactgaatttcataacttgtaaacaattatcagatacaaattaattttaatcaagctgttatttttgtactgataatttcaaaatccgatttctacaacactacagagcactgtttgcatccccatcctcaagacagtatatttaccttgactaatacagaactctaccccaaagtgaactgccttctgtctgtgtttacgaactttacttacttgatttagccagggaaataaatatttggaattttcttttaaagcatcttttttggtctactgtaagggaggagaattataaatgaaaagagtcaagaattttattatctgatgtgcttaattgtcacgctaagaacttaaaaaacaactcaaaaagagctaatagctaatctcctaaatctaaaaagggaattctttgaaattattttgctttcataatcaaatatattacttatgaagaataaaaataattcaaaccactacaataagtaaaatgggtatccatcacatactgtcatagagactaactgaagtagatcacttatgaatttccccattcaagtgctttcataaattcctcctcagtgaaagatagcatcttggcagcttcaatatgcatctgtt

SEQ ID NO: 286498 - DNA, 383 bp, Homo sapiens
gtcagttctcactatgtcccctcagctcccatctctgtatagcctggtgtttcctaggttatgattgtcgagtgaggattattataatattggaataaagagtaattgctacaaactaaggattaatgatattcatatataatcatatctaagatctatatctagtataactattcttattttatttattttattatactagaacagctcgtgccctcggtttcttgcctcggcacctgggtggcttgccacccacagccatcctagtgggtataaagtggtatttattcattatcagtagttacttacaaaaagaaaatcctgcgcagaccgaccctattcccccaaacacactctttgtttctccccagctgaaacagaac

SEQ ID NO: 286499 - DNA, 570 bp, Homo sapiens
agtcccaacaacataaagatgaaaagagaaggggagaaaaagttttaagggactattatagaaagtataaaatgtttgttagaatcaaatggtgagtaggagatctggaaaacagaaggattcagttgatgtgattaaaaaaagattttgttaaattgattattataaagggatgaacagtgagatgtgggtgttttgtagaaattattattttttaatatggagttaaagagctttctcccaaataccgagaaaagaaaaaaactacttactgattttaaaaactacttttatgatttaaaataatacatattaatcccactttttaaagacaacttaaattttgtgaaatttctttagcaaatttacccttttttcctttgggctacttctagcctaaccccataataacaaggtagctttaatccataaagttctaatatcaagaagtaaccagattttcctataaaacatccttttgcttctctctctccaaacttactctctatcactacccccaaggtctctttgttttagatatgcttgacatttaggacgggtacgtgtggg

SEQ ID NO: 286500 - DNA, 501 bp, Homo sapiens
tctcagaggaggttcaaattgtaatttgtcaactgcaaaatatataacagattttcagcaatgggcatgattttgtccataactggaaaataaaaattattcagaaattacaaaccaagggaattccatcgaaaccagaaaagcaacccctattttaaaagtattctgatatgttgaagtatgtagccttagtctgaaattttattattctacaaaacatacaagaacacgcagcacaaccctccaaaaccaccaatggaaaatgtaaaccaaacacatacaatttatttctgaagctgtccgttcagctctggcattcctgtttgtagatctaatggtatgacgaatgattgcatggggctgtgaatataagcataatatatatactttaacaaatttcaatgagaaagttaaaaggtcaaactttcttatcatttattgataaatatgaatatctactagtaaattataggataaacataaaacaaatacaatgaacgc

SEQ ID NO: 286501 - DNA, 542 bp, Homo sapiens
  misc_feature (502)..(502): n is a, c, g, or t
  misc_feature (534)..(534): n is a, c, g, or t
  misc_feature (538)..(538): n is a, c, g, or t
tctcagaggaggttcaaattgtaatttgtcaactgcaaaatatataacagattttcagcaatgggcatgattttgtccataactggaaaataaaaattattcagaaattacaaaccaagggaattccatcgaaaccagaaaagcaacccctattttaaaagtattctgatatgttgaagtatgtagccttagtctgaaattttattattctacaaaacatacaagaacacgcagcacaaccctccaaaaccaccaatggaaaatgtaaaccaaacacatacaatttatttctgaagctgtccgttcagctctggcattcctgtttgtagatctaatggtatgacgaatgattgcatggggctgtgaatataagcataatatatatactttaacaaatttcaatgagaaagttaaaaggtcaaactttcttatcatttattgataaatatgaatatctactagtaaattataggataaacataaaacaaatacaatgaacgcntggcctcgttggcctcagcggggagtctgcgncgtntcaa

SEQ ID NO: 286502 - DNA, 219 bp, Homo sapiens
  misc_feature (179)..(179): n is a, c, g, or t
  misc_feature (211)..(211): n is a, c, g, or t
  misc_feature (215)..(215): n is a, c, g, or t
atttcacagagaagactcttcggtattccaccatgggatggtaaagatctggctgccaggattcagtaagaaaaggaggattctggctttcttatccatcatgtaaatgtcccctgttttgaggatggttcccctgtcatctactgtatcccgtattcttaacatagccaaaataaacntggcctcgttggcctcagcggggagtctgcgncgtntcaa

SEQ ID NO: 286503 - DNA, 1094 bp, Homo sapiens
  misc_feature (28)..(28): n is a, c, g, or t
gcgggtggctgcggagccaggcgcggcncgagggatggtggacagcgtgtaccggacccgctccctgggggtggcggccgaagggctcccggaccagtacgcggacggggaggcggcgcgcgtgtggcagctgtatatcggagacacccgcagccgcaccgccgagtacaaggcatggctgcttgggctgctgcgccagcacggctgccagcgggtgctcgacgtagcctgtggcactggggtggactccattatgctggtggaagagggcttcagtgtgacgagtgtggatgccagtgacaagatgctgaagtatgcacttaaggagcgctggaaccggcggcacgagcccgccttcgacaagtgggtcatcgaagaagccaactggatgactctggacaaagatgtgccccagtcagcagagggtggctttgatgctgtcatctgccttggaaacagtttcgctcacttgccagactgcaaaggggaccagagtgagcaccggctggcgctgaaaaacattgcgagcatggtgcgggcagggggcctactggtcattgatcatcgcaactacgaccacatcctcagtacaggctgtgcacccccagggaagaacatctactataagagtgacttgaccaaggacgtcacaacatcagtgctgatagtgaacaacaaggcccacatggtgaccctggactatacggtgcaggtgccgggggctggccaggatggctctcctggcttgagtaagttccggctctcctactacccacactgtctggcatccttcacggagctgctccaagcagccttcggaggtaagtgccagcacagcgtcctgggcgacttcaagccttacaagccaggccaaacctacattccctgctacttcatccacgtgctcaagaggacagactgagtgtggcctcagctcccacaagcctctgcccaggcactgctaggctctgtctggaagatggggaccagcagccccacaccagggccagcctctagagcagactacagctggggtgcagggatgtgggttccacagacggaagggtaaacaatatagtctttttcagttcctg

SEQ ID NO: 286504 - DNA, 693 bp, Homo sapiens
  misc_feature (28)..(28): n is a, c, g, or t
  misc_feature (487)..(487): n is a, c, g, or t
  misc_feature (541)..(542): n is a, c, g, or t
  misc_feature (625)..(625): n is a, c, g, or t
gcgggtggctgcggagccaggcgcggcncgagggatggtggacagcgtgtaccggacccgctccctgggggtggcggccgaagggctcccggaccagtacgcggacggggaggcggcgcgcgtgtggcagctgtatatcggagacacccgcagccgcaccgccgagtacaaggcatggctgcttgggctgctgcgccagcacggctgccagcgggtgctcgacgtagcctgtggcactggggtggactccattatgctggtggaagagggcttcagtgtgacgagtgtggatgccagtgacaagatgctgaagtatgcacttaaggagcgctggaaccggcggcacgagcccgccttcgacaagtgggtcatcgaagaagccaactggatgactctggacaaagatgtgccccagtcagcagagggtggctttgatgctgtcatctgccttggaaacagtttcgctcacttgccagactgcaaaggngaccagagtgagcaccggctggcgctgcgacacatctcagtcaggctgtgaccnncaggagacattacttagagtgactgacaggacgacacatagtctgtaggacacaggccaatgtgactgacttcgtcagtccgngctgcagatgcttctgctgagaagtcgttctatacctgctgatctacgactgtcagagctcgagggcc

SEQ ID NO: 286505 - DNA, 1610 bp, Homo sapiens
  misc_feature (28)..(28): n is a, c, g, or t
gcgggtggctgcggagccaggcgcggcncgagggatggtggacagcgtgtaccggacccgctccctgggggtggcggccgaagggctcccggaccagtacgcggacggggaggcggcgcgcgtgtggcagctgtatatcggagacacccgcagccgcaccgccgagtacaaggcatggctgcttgggctgctgcgccagcacggctgccagcgggtgctcgacgtagcctgtggcactggggtggactccattatgctggtggaagagggcttcagtgtgacgagtgtggatgccagtgacaagatgctgaagtatgcacttaaggagcgctggaaccggcggcacgagcccgccttcgacaagtgggtcatcgaagaagccaactggatgactctggacaaagatgtgccccagtcagcagagggtggctttgatgctgtcatctgccttggaaacagtttcgctcacttgccagactgcaaaggggaccagagtgagcaccggctggcgctgaaaaacattgcgagcatggtgcgggcagggggcctactggtcattgatcatcgcaactacgaccacatcctcagtacaggctgtgcacccccagggaagaacatctactataagagtgacttgaccaaggacgtcacaacatcagtgctgatagtgaacaacaaggcccacatggtgaccctggactatacggtgcaggtgccgggggctggccaggatggctctcctggcttgagtaagttccggctctcctactacccacactgtctggcatccttcacggagctgctccaagcagccttcggaggtaagtgccagcacagcgtcctgggcgacttcaagccttacaagccaggccaaacctacattccctgctacttcatccacgtgctcaagaggacagactgagtgtggcctcagctcccacaagcctctgcccaggcactgctaggctctgtctggaagatggggaccagcagccccacaccagggccagcctctagagcagactacagctggggtgcagggatgtgggttccacagacggaagggtaaacaatatagtctttttcagttcctgaaaaaaaaagaaaaacaagaaaaaacaaaagcactcaaagaaaaaaaaaaaaaaaaaaaaggggggggggccctaaagaaaaaatctccccggggggggccccacaagttatgggggccagaccccggattttgtggtgtgaacaaaggggggccccatatagagggaggggttaatataacacaccagcggcacccgagaggcgcgcacggagtaacaaacacagcgccggagagggcgggaaaaaacgctggccacgcacgcgggcggaactgctggggaggcggaagaccaccatacaagccgcggaggggggggggaccacccaaaatgtgggcgaccccaagacatcaccacaaggaatataaggaccgcagggaggacccatacacaacattacaacgggctggtacacggtggaccacaacgcggaaaatattagcgccgcgcagagaacagtatggccaaaccaggcaccagtcattcagacaacttattacacgggcggggagcaaa

SEQ ID NO: 286506 - DNA, 1556 bp, Homo sapiens
  misc_feature (28)..(28): n is a, c, g, or t
gcgggtggctgcggagccaggcgcggcncgagggatggtggacagcgtgtaccggacccgctccctgggggtggcggccgaagggctcccggaccagtacgcggacggggaggcggcgcgcgtgtggcagctgtatatcggagacacccgcagccgcaccgccgagtacaaggcatggctgcttgggctgctgcgccagcacggctgccagcgggtgctcgacgtagcctgtggcactggggtggactccattatgctggtggaagagggcttcagtgtgacgagtgtggatgccagtgacaagatgctgaagtatgcacttaaggagcgctggaaccggcggcacgagcccgccttcgacaagtgggtcatcgaagaagccaactggatgactctggacaaagatgtgccccagtcagcagagggtggctttgatgctgtcatctgccttggaaacagtttcgctcacttgccagactgcaaaggggaccagagtgagcaccggctggcgctgaactacgaccacatcctcagtacaggctgtgcacccccagggaagaacatctactataagagtgacttgaccaaggacgtcacaacatcagtgctgatagtgaacaacaaggcccacatggtgaccctggactatacggtgcaggtgccgggggctggccaggatggctctcctggcttgagtaagttccggctctcctactacccacactgtctggcatccttcacggagctgctccaagcagccttcggaggtaagtgccagcacagcgtcctgggcgacttcaagccttacaagccaggccaaacctacattccctgctacttcatccacgtgctcaagaggacagactgagtgtggcctcagctcccacaagcctctgcccaggcactgctaggctctgtctggaagatggggaccagcagccccacaccagggccagcctctagagcagactacagctggggtgcagggatgtgggttccacagacggaagggtaaacaatatagtctttttcagttcctgaaaaaaaaagaaaaacaagaaaaaacaaaagcactcaaagaaaaaaaaaaaaaaaaaaaaggggggggggccctaaagaaaaaatctccccggggggggccccacaagttatgggggccagaccccggattttgtggtgtgaacaaaggggggccccatatagagggaggggttaatataacacaccagcggcacccgagaggcgcgcacggagtaacaaacacagcgccggagagggcgggaaaaaacgctggccacgcacgcgggcggaactgctggggaggcggaagaccaccatacaagccgcggaggggggggggaccacccaaaatgtgggcgaccccaagacatcaccacaaggaatataaggaccgcagggaggacccatacacaacattacaacgggctggtacacggtggaccacaacgcggaaaatattagcgccgcgcagagaacagtatggccaaaccaggcaccagtcattcagacaacttattacacgggcggggagcaaa

SEQ ID NO: 286507 - DNA, 397 bp, Homo sapiens
  misc_feature (137)..(137): n is a, c, g, or t
agactcgggcgcccggcccaaagcccggcaggggcgtgtccgcgcgctcacctgctattggccaggtggggctgtcggctgccagcagtgcttatgctttaagtgcggagcgggtggctgcggagccaggcgcggcncgagggatggtggacagcgtgtaccggacccgctccctgggggtggcggccgaagggctcccggaccagtacgcggacggggaggcggcgcgcgtgtggcagctgtatatcggagacacccgcagccgcaccgccgagtacaaggcatggctgcttgggctgctgcgccagcacggctgccagcgggtgctcgacgtagcctgtggcactgggtgagcccaggccggggccgggggcgttgcatgagatcggggtctgtc

SEQ ID NO: 286508 - DNA, 751 bp, Homo sapiens
ttcttactgatatcaagacatttttatttattaaacatgttgtcaaacagaaaacaaaaggtccaggtagctctttctttgggcccttggcaatgaatgttgccaccactgttctgggtgcagaggggaaatggaaggcaaggacagcagagccagcacttgaccaggggcccgctggttacggacgacggaaaattgactgatccaagtggacaggtaagccattttcacaagcaacaacaacgtttctgaaccccgctgtggctcggtactggcatggaggccagggggaccctccatgtagcttgcaagtggtgacctggaaagaagacttgcttattcttaggttttctctgtgagggtttccattcttgttttcacagatggccttgatgctgcgcttgttgccatgaataaatgtgttgatgtctttgcagggtgaggtcaggccccgtctcctcatgatgctttcacagtatctgtcatcccggccctgtggtttggcatcatagtgctgggtcaggaagtgtgtgtacctggagttatcctgagccagggtcggtggggtcagacccagacccagcacgaagaccaacaacaaaacgcccaggcccatcaccatctcttccaacacaggctcccaggaggaagaatcttacaaaaatctggcagtttcccttcaacgggagatgggttccagctgtttgttcctggagatgggttccagttgtgtgaacctggactcgtgccg

SEQ ID NO: 286509 - DNA, 698 bp, Homo sapiens
ttcttactgatatcaagacatttttatttattaaacatgttgtcaaacagaaaacaaaaggtccaggtagctctttctttgggcccttggcaatgaatgttgccaccactgttctgggtgcagaggggaaatggaaggcaaggacagcagagccagcacttgaccaggggcccgctggttacggacgacggaaaattgactgatccaagtggacaggtaagccattttcacaagcaacaacaacgtttctgaaccccgctgtggctcggtactggcatggaggccagggggaccctccatctgtgagggtttccattcttgttttcacagatggccttgatgctgcgcttgttgccatgaataaatgtgttgatgtctttgcagggtgaggtcaggccccgtctcctcatgatgctttcacagtatctgtcatcccggccctgtggtttggcatcatagtgctgggtcaggaagtgtgtgtacctggagttatcctgagccagggtcggtggggtcagacccagacccagcacgaagaccaacaacaaaacgcccaggcccatcaccatctcttccaacacaggctcccaggaggaagaatcttacaaaaatctggcagtttcccttcaacgggagatgggttccagctgtttgttcctggagatgggttccagttgtgtgaacctggactcgtgccg

SEQ ID NO: 286510 - DNA, 961 bp, Homo sapiens
tccggcagaacagctgacaccaccaactttaaagagcccaactgatgaactgatcagcatgagaatactgttttttcatctctctgtcccatgacttcactctgcattcttcaaccaattagtgatctcttatttccacctactccaaatccttaaaaacaacagcctcaaactctttgaggaaatggatttgaggtttccttccatcttttggttcagcagccctgcaattaaacctctttctctgctgcaacccagtgtcttggcatattgacatgctgtgcacatcaggcaaaagacctattaccattacatgaggacccctccggagggagataatggtgggggcatttctgggaggctctgctttagtcagggtgcacgtgttgccgcaggaatcgctggtacatgccatcctggccataggagggctggaccagccccagccccagcagggtcagcagcaaaagcagaagcaatgaatgggtcctctgcagagccatcagtatcttagaggtgcctagaaaagaaagcaaggggcaggagaaataagagagaagttgctgtggccagtacaatgacacagggcagggactgactgcgtggctgccaggtttgtgtggacagagtataaaaagagagaaaagggtgaggtcaggccccgtctcctcatgatgctttcacagtatctgtcatcccggccctgtggtttggcatcatagtgctgggtcaggaagtgtgtgtacctggagttatcctgagccagggtcggtggggtcagacccagacccagcacgaagaccaacaacaaaacgcccaggcccatcaccatctcttccaacacaggctcccaggaggaagaatcttacaaaaatctggcagtttcccttcaacgggagatgggttccagctgtttgttcctggagatgggttccagttgtgtgaacctggactcgtgccg

SEQ ID NO: 286511 - DNA, 391 bp, Homo sapiens
tgatggggtcttgttacattgcccaggctggagtacagtggctgttcataggcatgattatagtctcctagagccctgagctcctgggctcaagtgatcctcatgcctcagcctcctgagtagctgcgactatggccacaggttctgcgcctggctatagtgacgtttctgaaggatagtgcataatcataactcaatgaagacatatctgcaaggagctatgatgtaccatggtctggttacttgaagttttgtataaagcataatctaatgccatgattgattgatagtgtttggagagattctgtggatgttttttaaaaatacaaggttccacttgcagtttaattttcccatagataacagttataaacttgggacaaaatctgaa

SEQ ID NO: 286512 - DNA, 283 bp, Homo sapiens
attgtgtggatgttaatgtatttcttgaactgttaaagtttaattgtaaggagtccaatctgttgagtgaaaatatgacagattgataatggcatcaatgatagatcttgtagttataatcctacttttatgtgtttgttcatgcctgttgatccatctgaaaggttttgttgagctacttcattcccgctcctcctgtgttgaagccaagttgtacttcagttgaactctgtacagaatgattttaggctgaccaataattttttctgttccctaggactca

SEQ ID NO: 286513 - DNA, 504 bp, Homo sapiens
tcccggattcaggcaattcttgtgtctcagcctcctaagaagctgagattacagcaactccaaaatggaagtactattgttatctccgtttacaaattaggaaactgaggcacagatatgctcttgggtacttgtcagcagcagttgttctacaaatgagcgtcttagcctctggattactgcccaatgaggaaagctatgaaatgcatggataacttgctaatcagtatttgccatatgtgctagcagcatcagcatcagttgggagattatggtggcctccatgtcagacctcctaaatcggaatatcagagaaggtggcccaggttaccatgcttcatctgccaatgcattgaaaacttggaatgtaaattaattcaaccattgtggaagatggtgtagtgattcctcaaagacctagaagcagaaatatcatttgatccagaaatcccattactgtgtatacacccaaaggaatataaaccattctattacaaagataaa

SEQ ID NO: 286514 - DNA, 533 bp, Homo sapiens
tcccggattcaggcaattcttgtgtctcagcctcctaagaagctgagattacagcaactccaaaatggaagtactattgttatctccgtttacaaattaggaaactgaggcacagatatgctcttgggtacttgtcagcagcagttgttctacaagctaaatatctggatatcttaaatctcagatgagcgtcttagcctctggattactgcccaatgaggaaagctatgaaatgcatggataacttgctaatcagtatttgccatatgtgctagcagcatcagcatcagttgggagattatggtggcctccatgtcagacctcctaaatcggaatatcagagaaggtggcccaggttaccatgcttcatctgccaatgcattgaaaacttggaatgtaaattaattcaaccattgtggaagatggtgtagtgattcctcaaagacctagaagcagaaatatcatttgatccagaaatcccattactgtgtatacacccaaaggaatataaaccattctattacaaagataaa

SEQ ID NO: 286515 - DNA, 301 bp, Homo sapiens
ctttaaacttgctcgcagttctggaaaacaatcaactccggtttccacagccagttagaggagtaagctgaacaccgctgaaccaggagtcaacggtctttacttgcccttggtatttccccagtgactcagaatgttgtgggatgtcagtattccaggaaaagcaaaaagtgaggggttgagaggatgttttgagaataaataagtttggagaatggtgactctctgttcctatcttggtgactcataatgcacatgaacttggtagaattttgagaaataacagagtagaaagatagca

SEQ ID NO: 286516 - DNA, 372 bp, Homo sapiens
aactcgggtttggttcgtcctccaaacacgtgaacacgtgttgagcactgactgtgaattcggcagctgtgatgggggctgaactcagggccaaggagccaggctccactccactgtgacaccaggtgtggggctcgggctggagtgcagcagtgtgatcatggctcactgtggcctctacctcctgggaccaagcaatcctcctgtatcagcctctggagtagctgggattacaggcatgcaccaccacacctggctaattatttagttttggtagagatggggtctcactatgttgcccagacttccctctgtcaatgacagacataattcaatcattcattcattcaataaatatttattgagcaccta

SEQ ID NO: 286517 - DNA, 608 bp, Homo sapiens
  misc_feature (96)..(96): n is a, c, g, or t
  misc_feature (101)..(101): n is a, c, g, or t
  misc_feature (107)..(107): n is a, c, g, or t
ggagagcggcgcccagcatgacggcgatggcggcgcgcgggctgaggacagagagaagccggtgctggagtgcaatgactcgacctcggttcaccnacaancccccnacctcctgggttcaagtaattctcctgcctcagcctcccaagtagctgggattacaggcatctgccaccatgaccagctaattttgtatttgtagcagacacggtgtttctctatgttggccaggctcgtctcaaactcctgacctcaggtgatccgcccaccttggcctcccaaagtgctgggattacaggcgtgagccaccgcgccctgcctgctttttattttttaagagactgggtctggctattttgcccaggctggtgttgaactcctggactcaagtgatcctcctgcctcagcctccccagtagctgggactacaggttgcgacaccaacccaggctgtggcagttatttaacagtgtttctctccagaaacatgttcaaaccattactgaaggtgaaaagcaaaagaaggggatttaattttgtgtctctcttaccactgtaaatgtggctacataacatctcagagaataaacaatcttgatgaaccatca

SEQ ID NO: 286518 - DNA, 880 bp, Homo sapiens
gattcaggaaacatctggcaaagatgatataagtgcctgttaagcagaaatgtaaagtcaggagagaatgactttagataagaaacacagaaaagccctgcaagccactttcctatgcagtcacctgttgactgagcaagtaagaactggatgaatccgctttttctaacagcattcttaagagtctacactcacttctgccatttcctaaaaactcagccataacattatggactggaggtggtgggagaaacagctcgatttgtggtacagacgttgttgggggcaccactctgtgtggcagctgcagctgacagctccaaggcactttccatattaactcatttattcctcacgacaggtacttctttgatagtgcctccatgcatgcagaagatgacgtggagagctccgcgcggcacagggcaggaagctggtgtgcactctcatggatccgaagccaacacacgcctctcaactgaggactctgcccctctggcattcttccagccaccagccctgggggccaggagccactgagtgggtcacacagccttagagggcaacgagggcaggagctcgccctggcggtccccatgcagacaagaggtacacactccctggcatgcagagccacccaactgggtttcactgaagggtgaggggcggggtgtctaccgtgctttccaaataccgctcagtcacccagagcttgaaacttacaatgagccaccccatcccagccacaaatctaaaggggttcacttgtttcaaaatcaacttgtttgtggttaaaagtcagtcccagctctacagtggctggagcggcacgtgtgagaagccggcttgcgctgtgaggctcacaagccctgggtgacca

SEQ ID NO: 286519 - DNA, 397 bp, Homo sapiens
ttctcgccggtcctgcgggtcgctgctcggctgtgggttagcagcaccctgagcggagcggaagagctgcccgccgccgcgtaaccccgaggccgagactcctggcctggcctccttgggcccacgacgcctgccccgcggagcggacccatgggcctgaggtttgtgtgcggggcctcaggcgagcggtgtgtcctggaaccctggctgcacccacagatacagccactcctgggcccatgtggatgtaaccttcgagtgccggaatgcctcgtctccatggagaccaaactcaagggcctgactggcccagtctaccgagaccatgagacctgctgtgcccctcggccaggccaacccaaattcttttaaataaaaggcacaagccacagccaca

SEQ ID NO: 286520 - DNA, 4491 bp, Homo sapiens
  misc_feature (1999)..(1999): n is a, c, g, or t
  misc_feature (4466)..(4466): n is a, c, g, or t
ttctcgccggtcctgcgggtcgctgctcggctgtgggttagcagcaccctgagcggagcggaagagctgcccgccgccgcgtaaccccgaggccgagactcctggcctggcctccttgggcccacgacgcctgccccgcggagcggacccatgggcctgaggtttgtgtgcggggcctcaggcgagcgctggcgcagcctgtcccccatcgtctgcgccctgcgggcctggccctccccgtggaaggaccgcgggcttcggggccccacgctggggggctgactcctgccacacacacagcggtggccgcgggcctggggcggcagcacagccattctgctcgggctgcgtgagctgaccccgctctctgtgcacctacttttgctgcgtttggtgctgagcctgaagtcccaggacaggcggctgagggggaaagatggtgtgaattgggtgggcagagacaactgaaagccacaggacccggttggcacctttttggccgcctgcgcctttgcctgcagccccgctccctgggtcacccgaaggaggagctggcgctctttccgggcgcagaagcacccgacccacgctggaggaaacggtccctctgggcaggagaagctttgggcctggctggagcacactcacggaaccacgccaacgcctggcctgtagccagctcccacctcccctcccaccttctaaaatgcttgcggatctcacgtggccgaccctaaccagatacacatggggaaaggaatcaggtggcacacataccgcctttactccatagagaacttccaattgtgggtaagaacaaagccccacctctgcctaatagatgcagttttccacctgcagccaaaaagacaacctgttattagcttttttcccagaggacaggcatctctatgaaactgccattgcaaaatttgccgacagtgagataaccagctccattttgcttctaacctccatgccctccttgtttactgctgcacgcaggttgaactgtgggaggaacttagtttaaaacaaagatgataacagccctttcccaaaggaaacctttcctggggattagcctgcttttgtgggaccaacagattagccacaagattagaaactacggttgaagagtcacgcagcgggaggctacaggattctgaccctccccaaactgctcctggcgataacatcaccatcgtaaagcctaagatcagcacttggtgggtcacctggcaccacccaggctcatctgatgttgtggcacccaggaactgactcagtgcgaaaacagcttcgactccctgtgatttcatctctgacctgaccaatgggtacttctgactcactggctgccccccacccaccagcttatctttaaaaactccaaaccccagatgctcagggagaccgagtaataataaaactccagtctcccacacagctagctctgcgtgaattaccttttctctgttgcaaatgccctttcttgataaattggctgtctaggtaacagggaaggtgaacccactgggcagttacacttttatccacccttccagctggatcacgcgccctcttcaatgacatgacacgcagctagagtgtatgagcttgctgccggcaccttccgtcctggatcgcatagcaaggcctcaatggacagccaggtgcctggtccggtcccacttttttttctgtcctgttctcgtttcctctttgcttggccaaagagggttgggccagggtcctgagtgcaagggcttggcttggtgaattaaagtggcagtagccgtgtggcagagaaaatttgtagatgggtgaaatcctgggcctacacagtgacaaagtgtatatagacagccagcctagttggtggatgtgacaaccccagactcttctagatttgtggatccgtgcacctgccagacctgtctctgagccatctggggaggctgggtaagatttcccccgtcagggcctgagcctcatntccaagctgctggcttcagcccagctgccaccagcgctgtctctgtcttgcgctttccagagagagactgactcattttgagctccaggcctaccaggcagcccaaccgcggcagtaactgcctctcacactgaggatggctcatgctctggtccagccatggcttgaacacctcccaacaagaacaaagccagactcattctccctagcatcttcttccttgctcaaagatcccacaccccgttagaagctggaactgggtccttgtcaccttcctcacctccccagtcgtagtctggttaatccttacatctcaccacggtcaccgtggctagatgtgacctccgcgatgcttcaggcacgtactagggcagcctgggcagggctggtcactgtgatctcatgaggtgtgaacttgaccccggccttctttcctgggatgccggctaaggacacaagttcagtgtttgccctggcttgtagcccagcgggggctccgtcatcccctggggaatgcctcggcctgcaagaccgcataccgcattggaacagggaaaccacctacttcagcacctccctcagcaaggtggcaggtcccaacaagccttgcaccacgaggaagtggcagtggcattcgggatatggctccctggccagcttgtgaagttcaaggggctcgttacttcttacagctcacagtccctcccgggtccagcacacctgagggctgacctccctcttgattagtgcaggggaaaagcactttaaaaagctgtgtcatgcgtaacttgcacatcttctgattctgacctgaaactgcatcccaggtcggcacagacgcaacccagtctcctcccacctccgagagtgcagtgtcctgaatggagaaccccagcacccagaagcatccactgaaggacgtaagtaggacaaggccaactgtggctgttccagcagagggactgtgggtgatgtttcccttctctgatttctaaaatatctgcaaacttgtttcatttataattgaaaatataatttgcataacaacagtaaattctacacatgaaggcaaacgtccgtggttgacagaaattacactggccagaatccccagtccccatgaggcttgtccagacgcagtgaaccagtcgcagctgataacacacagaccattcccgatcccagaggtgcatttcaggattcattctatttcatcagagacggggtcttcctgtgttgcccaggctggtctcgaactcctgggctgaagcaatcttcctgccttggcctcccagagggttggaattgcagatgtgaggtacttctttgatagtgcctccatgcatgcagaagatgacgtggagagctccgcgcggcacagggcaggaagctggtgtgcactctcatggatccgaagccaacacacgcctctcaactgaggactctgcccctctggcattcttccagccaccagccctgggggccaggagccactgagtgggtcacacagccttagagggcaacgagggcaggagctcgccctggcggtccccatgcagacaagagggtcactggcttccttgctttgctcttcctggacatcttcctcgacattcatctttccatcctaccaagagcgtggaaaccacagggcatgaggacaggcggagacaacgctggaccatctcacagccacatcaagaggctgcccacatcagggctttctacgtggttgcaaggaacacaaacctgtgtgctccatttgcccactggcactaggcctcctgcccaccacccgcttctaggctattcgagccgcaggagctacaggctgctagagaaccctgcggcaggatgctgggcgcggttcagcttttgccagggagcagcatgggactgggatttggaaggtgtacagtggctgcgggctttagcaggaggagtgtctacagcaccttctgctcctccaggtaacctagtgtttttatcagtatccattttcctgtgtggatctcttctgcttgaaacctgtcctgcctatttttcttccctggaccctgactgatacactcttaaaacgagaaaagggtaccgatttataaagttcgtgaattaaaaactacaccagtcatggaaactcaatgacatcactcaaagaaaattcacaactctagccttgagttagctccctcaatagtatgatgaggtcatgcagatagaatcatacagttattaacaaaagtagttgatgttaaccgagtaatcagttttatctgtgttcctttgagacagagagagagagtgagaaagagagcgtgagcaagtgagtgcacatactattgttaaagtcttctctctaaagttttaatatctgatataccataaacacccagataaagaactttagagaaactggttaaaaagatttaaaattcccaactgtaataaatccctaaaatgaataccnaaaaaatgtttttaaattaaaaaaa

SEQ ID NO: 286521 - DNA, 3816 bp, Homo sapiens
ttctcgccggtcctgcgggtcgctgctcggctgtgggttagcagcaccctgagcggagcggaagagctgcccgccgccgcgtaaccccgaggccgagactcctggcctggcctccttgggcccacgacgcctgccccgcggagcggacccatgggcctgaggtttgtgtgcggggcctcaggcgagcgctggcgcagcctgtcccccatcgtctgcgccctgcgggcctggccctccccgtggaaggaccgcgggcttcggggccccacgctggggggctgactcctgccacacacacagcggtggccgcgggcctggggcggcagcacagccattctgctcgggctgcgtgagctgaccccgctctctgtgcacctacttttgctgcgtttggtgctgagcctgaagtcccaggacaggcggctgagggggaaagatggtgtgaattgggtgggcagagacaactgaaagccacaggacccggttggcacctttttggccgcctgcgcctttgcctgcagccccgctccctgggtcacccgaaggaggagctggcgctctttccgggcgcagaagcacccgacccacgctggaggaaacggtccctctgggcaggagaagctttgggcctggctggagcacactcacggaaccacgccaacgcctggcctgtagccagctcccacctcccctcccaccttctaaaatgcttgcggatctcacgtggccgaccctaaccagatacacatggggaaaggaatcaggtggcacacataccgcctttactccatagagaacttccaattgtgggtaagaacaaagccccacctctgcctaatagatgcagttttccacctgcagccaaaaagacaacctgttattagcttttttcccagaggacaggcatctctatgaaactgccattgcaaaatttgccgacagtgagataaccagctccattttgcttctaacctccatgccctccttgtttactgctgcacgcaggttgaactgtgggaggaacttagtttaaaacaaagatgataacagccctttcccaaaggaaacctttcctggggattagcctgcttttgtgggaccaacagattagccacaagattagaaactacggttgaagagtcacgcagcgggaggctacaggattctgaccctccccaaactgctcctggcgataacatcaccatcgtaaagcctaagatcagcacttggtgggtcacctggcaccacccaggctcatctgatgttgtggcacccaggaactgactcagtgcgaaaacagcttcgactccctgtgatttcatctctgacctgaccaatgggtacttctgactcactggctgccccccacccaccagcttatctttaaaaactccaaaccccagatgctcagggagaccgagtaataataaaactccagtctcccacacagctagctctgcgtgaattaccttttctctgttgcaaatgccctttcttgataaattggctgtctaggtaacagggaaggtgaacccactgggcagttacacttttatccacccttccagctggatcacgcgccctcttcaatgacatgacacgcagctagagtgtatgagcttgctgccggcaccttccgtcctggatcgcatagcaaggcctcaatggacagccaggtgcctggtccggtcccacttttttttctgtcctgttctcgtttcctctttgcttggccaaagagggttgggccagggtcctgagtgcaagggcttggcttggtgaattaaagtggcagtagccgtgtggcagagaaaatttgtagatgggtgaaatcctgggcctacacagtgacaaagtgtatatagacagccagcctagttggtggatgtgacaaccccagactcttctagatttgtggatccgtgcacctgccagacctgtctctgagccatctggggaggctgggtcggcacagacgcaacccagtctcctcccacctccgagagtgcagtgtcctgaatggagaaccccagcacccagaagcatccactgaaggacgtgtgtcctggaaccctggctgcacccacagatacagccactcctgggcccatgtggatgtaaccttcgagtgccggaatgcctcgtctccatggagaccaaactcaagggcctgactggcccagtctaccgagaccatgagacctgctgtgcccctcggccaggccaacccaaattcttttaaataaaaggcacaagccacagccacaccagcaggaagtggatacaggataaggggcagggctcacatctcatcctcatcagcctttgaccaggcgacggagtctgtgatagctagcttatctgctctatgctccagggacctggccggaacgagccgagttgctgtcctcatggaactctcatcctagtggggcagagacaaggacggtgtaacgtgcccgggggtcagcaccacagacaaaacgcagggagcacggcacagtgtgggccagggaaggcctggcttcccaagggtgtgggcgcgagcagcatggctgtggggagttccaggtgcagagaactactccagagacgaagccaggcctgcgaggaggccggagcgcatgaggggaaggcacgaggcaaggctgccagggctgtgctggtggtgcgggacggtcctgtgggggtagctgcggagatggcactgatgccttcggctccagcagcatcctgggctggtgcgggccaataaggggcagggttggggcaggatgaaaggcacaagccacagccatgtcaagcaggaagtggatgcagggtacagcctgtcagggtcagggtgaaaggcagggaggcgggtaggccataggtgaatttggagcagcctgtagaggacaggatgtgccatcaaagacttgttcttgggtccagctgagactgtcccttggggcttcctgtcaccttgtgcaggatagtgagaccatccttggaaaacccatcgggactgcagagcgcggctcagagctgactgtccaggcctggcaggggctgacccctgggcgctggtgcaccctccgtgcggcctcttggaggaagcacacaaggcgacagttcccagctgccgcctgagatgcagcatctgctttactccagcccagcactgctcaccgtcactgcccactcttatgattttacttcccttcatatttgtgattttgcaaagatggtgttgacttacagctgcagcatcaaatgactgactgccaccagcttggccccagctcagggacatgtctgagcccaggcagagcaccctagtggccgggaagcctcacctggagctcctgcgggtggctgcagtccgccaggtgatccgtgaggagggcttggagaggccccatgatggcgtggaaggatggcagggacccgtacatgagcacgcagcgcttcagcagggccaggcccacagccaggcaggacagtctgtgagggcaggaggcaagaggaggtccaacttgttctgtttgtcactgacaaaaccaataacgtggcaaaaatgaacttccccacttccactaggctgaaaactccagtgtggccaccttggccggccagggttgggcccatgcaaccacgggcaaggcaggctcagggtcaggcctaacgcaggaggggaggctgtgggaaccgcagcgccagctgggatggggcggctccatttttggttccaaattatgatttgtgaaatcaagcaaatgtattttgaaaatgaaaagaaaaagggacagcaagccaacatgcctcagaaaggct

SEQ ID NO: 286522 - DNA, 3955 bp, Homo sapiens
  misc_feature (1999)..(1999): n is a, c, g, or t
ttctcgccggtcctgcgggtcgctgctcggctgtgggttagcagcaccctgagcggagcggaagagctgcccgccgccgcgtaaccccgaggccgagactcctggcctggcctccttgggcccacgacgcctgccccgcggagcggacccatgggcctgaggtttgtgtgcggggcctcaggcgagcgctggcgcagcctgtcccccatcgtctgcgccctgcgggcctggccctccccgtggaaggaccgcgggcttcggggccccacgctggggggctgactcctgccacacacacagcggtggccgcgggcctggggcggcagcacagccattctgctcgggctgcgtgagctgaccccgctctctgtgcacctacttttgctgcgtttggtgctgagcctgaagtcccaggacaggcggctgagggggaaagatggtgtgaattgggtgggcagagacaactgaaagccacaggacccggttggcacctttttggccgcctgcgcctttgcctgcagccccgctccctgggtcacccgaaggaggagctggcgctctttccgggcgcagaagcacccgacccacgctggaggaaacggtccctctgggcaggagaagctttgggcctggctggagcacactcacggaaccacgccaacgcctggcctgtagccagctcccacctcccctcccaccttctaaaatgcttgcggatctcacgtggccgaccctaaccagatacacatggggaaaggaatcaggtggcacacataccgcctttactccatagagaacttccaattgtgggtaagaacaaagccccacctctgcctaatagatgcagttttccacctgcagccaaaaagacaacctgttattagcttttttcccagaggacaggcatctctatgaaactgccattgcaaaatttgccgacagtgagataaccagctccattttgcttctaacctccatgccctccttgtttactgctgcacgcaggttgaactgtgggaggaacttagtttaaaacaaagatgataacagccctttcccaaaggaaacctttcctggggattagcctgcttttgtgggaccaacagattagccacaagattagaaactacggttgaagagtcacgcagcgggaggctacaggattctgaccctccccaaactgctcctggcgataacatcaccatcgtaaagcctaagatcagcacttggtgggtcacctggcaccacccaggctcatctgatgttgtggcacccaggaactgactcagtgcgaaaacagcttcgactccctgtgatttcatctctgacctgaccaatgggtacttctgactcactggctgccccccacccaccagcttatctttaaaaactccaaaccccagatgctcagggagaccgagtaataataaaactccagtctcccacacagctagctctgcgtgaattaccttttctctgttgcaaatgccctttcttgataaattggctgtctaggtaacagggaaggtgaacccactgggcagttacacttttatccacccttccagctggatcacgcgccctcttcaatgacatgacacgcagctagagtgtatgagcttgctgccggcaccttccgtcctggatcgcatagcaaggcctcaatggacagccaggtgcctggtccggtcccacttttttttctgtcctgttctcgtttcctctttgcttggccaaagagggttgggccagggtcctgagtgcaagggcttggcttggtgaattaaagtggcagtagccgtgtggcagagaaaatttgtagatgggtgaaatcctgggcctacacagtgacaaagtgtatatagacagccagcctagttggtggatgtgacaaccccagactcttctagatttgtggatccgtgcacctgccagacctgtctctgagccatctggggaggctgggtaagatttcccccgtcagggcctgagcctcatntccaagctgctggcttcagcccagctgccaccagcgctgtctctgtcttgcgctttccagagagagactgactcattttgagctccaggcctaccaggcagcccaaccgcggcagtaactgcctctcacactgaggatggctcatgctctggtccagccatggcttgaacacctcccaacaagaacaaagccagactcattctccctagcatcttcttccttgctcaaagatcccacaccccgttagaagctggaactgggtccttgtcaccttcctcacctccccagtcgtagtctggttaatccttacatctcaccacggtcaccgtggctagatgtgacctccgcgatgcttcaggcacgtactagggcagcctgggcagggctggtcactgtgatctcatgaggtgtgaacttgaccccggccttctttcctgggatgccggctaaggacacaagttcagtgtttgccctggcttgtagcccagcgggggctccgtcatcccctggggaatgcctcggcctgcaagaccgcataccgcattggaacagggaaaccacctacttcagcacctccctcagcaaggtggcaggtcccaacaagccttgcaccacgaggaagtggcagtggcattcgggatatggctccctggccagcttgtgaagttcaaggggctcgttacttcttacagctcacagtccctcccgggtccagcacacctgagggctgacctccctcttgattagtgcaggggaaaagcactttaaaaagctgtgtcatgcgtaacttgcacatcttctgattctgacctgaaactgcatcccaggtcggcacagacgcaacccagtctcctcccacctccgagagtgcagtgtcctgaatggagaaccccagcacccagaagcatccactgaaggacgtacttctttgatagtgcctccatgcatgcagaagatgacgtggagagctccgcgcggcacagggcaggaagctggtgtgcactctcatggatccgaagccaacacacgcctctcaactgaggactctgcccctctggcattcttccagccaccagccctgggggccaggagccactgagtgggtcacacagccttagagggcaacgagggcaggagctcgccctggcggtccccatgcagacaagagggtcactggcttccttgctttgctcttcctggacatcttcctcgacattcatctttccatcctaccaagagcgtggaaaccacagggcatgaggacaggcggagacaacgctggaccatctcacagccacatcaagaggctgcccacatcagggctttctacgtggttgcaaggaacacaaacctgtgtgctccatttgcccactggcactaggcctcctgcccaccacccgcttctaggctattcgagccgcaggagctacaggctgctagagaaccctgcggcaggatgctgggcgcggttcagcttttgccagggagcagcatgggactgggatttggaaggtgtacagtggctgcgggctttagcaggaggagtgtctacagcaccttctgctcctccagaaataaggaaactgaggcacagctataaagcaatgtcctgagactggcacctgggggctgccctcttcctgccagactgagtgcctcagagtgctacaactgaccagaggggagaagccaactgaggcagcctgtttacttctaagggactaacccacatgaaaagacccaggcctcctgcgccggcctcacggcccctacacgcgttatcaagcttggagtcaactggacgacctgctgtccctcagacagctgtgagtgccacacttcaccataccgggacaatgtgcctttgcatgtgtgtcctctgccaccctgggcccatgaacagctcactccccttgcaaaacttgactgtaactccctctagaagaatttttggac

SEQ ID NO: 286523 - DNA, 3396 bp, Homo sapiens
  misc_feature (1999)..(1999): n is a, c, g, or t
ttctcgccggtcctgcgggtcgctgctcggctgtgggttagcagcaccctgagcggagcggaagagctgcccgccgccgcgtaaccccgaggccgagactcctggcctggcctccttgggcccacgacgcctgccccgcggagcggacccatgggcctgaggtttgtgtgcggggcctcaggcgagcgctggcgcagcctgtcccccatcgtctgcgccctgcgggcctggccctccccgtggaaggaccgcgggcttcggggccccacgctggggggctgactcctgccacacacacagcggtggccgcgggcctggggcggcagcacagccattctgctcgggctgcgtgagctgaccccgctctctgtgcacctacttttgctgcgtttggtgctgagcctgaagtcccaggacaggcggctgagggggaaagatggtgtgaattgggtgggcagagacaactgaaagccacaggacccggttggcacctttttggccgcctgcgcctttgcctgcagccccgctccctgggtcacccgaaggaggagctggcgctctttccgggcgcagaagcacccgacccacgctggaggaaacggtccctctgggcaggagaagctttgggcctggctggagcacactcacggaaccacgccaacgcctggcctgtagccagctcccacctcccctcccaccttctaaaatgcttgcggatctcacgtggccgaccctaaccagatacacatggggaaaggaatcaggtggcacacataccgcctttactccatagagaacttccaattgtgggtaagaacaaagccccacctctgcctaatagatgcagttttccacctgcagccaaaaagacaacctgttattagcttttttcccagaggacaggcatctctatgaaactgccattgcaaaatttgccgacagtgagataaccagctccattttgcttctaacctccatgccctccttgtttactgctgcacgcaggttgaactgtgggaggaacttagtttaaaacaaagatgataacagccctttcccaaaggaaacctttcctggggattagcctgcttttgtgggaccaacagattagccacaagattagaaactacggttgaagagtcacgcagcgggaggctacaggattctgaccctccccaaactgctcctggcgataacatcaccatcgtaaagcctaagatcagcacttggtgggtcacctggcaccacccaggctcatctgatgttgtggcacccaggaactgactcagtgcgaaaacagcttcgactccctgtgatttcatctctgacctgaccaatgggtacttctgactcactggctgccccccacccaccagcttatctttaaaaactccaaaccccagatgctcagggagaccgagtaataataaaactccagtctcccacacagctagctctgcgtgaattaccttttctctgttgcaaatgccctttcttgataaattggctgtctaggtaacagggaaggtgaacccactgggcagttacacttttatccacccttccagctggatcacgcgccctcttcaatgacatgacacgcagctagagtgtatgagcttgctgccggcaccttccgtcctggatcgcatagcaaggcctcaatggacagccaggtgcctggtccggtcccacttttttttctgtcctgttctcgtttcctctttgcttggccaaagagggttgggccagggtcctgagtgcaagggcttggcttggtgaattaaagtggcagtagccgtgtggcagagaaaatttgtagatgggtgaaatcctgggcctacacagtgacaaagtgtatatagacagccagcctagttggtggatgtgacaaccccagactcttctagatttgtggatccgtgcacctgccagacctgtctctgagccatctggggaggctgggtaagatttcccccgtcagggcctgagcctcatntccaagctgctggcttcagcccagctgccaccagcgctgtctctgtcttgcgctttccagagagagactgactcattttgagctccaggcctaccaggcagcccaaccgcggcagtaactgcctctcacactgaggatggctcatgctctggtccagccatggcttgaacacctcccaacaagaacaaagccagactcattctccctagcatcttcttccttgctcaaagatcccacaccccgttagaagctggaactgggtccttgtcaccttcctcacctccccagtcgtagtctggttaatccttacatctcaccacggtcaccgtggctagatgtgacctccgcgatgcttcaggcacgtactagggcagcctgggcagggctggtcactgtgatctcatgaggtgtgaacttgaccccggccttctttcctgggatgccggctaaggacacaagttcagtgtttgccctggcttgtagcccagcgggggctccgtcatcccctggggaatgcctcggcctgcaagaccgcataccgcattggaacagggaaaccacctacttcagcacctccctcagcaaggtggcaggtcccaacaagccttgcaccacgaggaagtggcagtggcattcgggatatggctccctggccagcttgtgaagttcaaggggctcgttacttcttacagctcacagtccctcccgggtccagcacacctgagggctgacctccctcttgattagtgcaggggaaaagcactttaaaaagctgtgtcatgcgtaacttgcacatcttctgattctgacctgaaactgcatcccaggtcggcacagacgcaacccagtctcctcccacctccgagagtgcagtgtcctgaatggagaaccccagcacccagaagcatccactgaaggactaaattctacacatgaaggcaaacgtccgtggttgacagaaattacactggccagaatccccagtccccatgaggcttgtccagacgcagtgaaccagtcgcagctgataacacacagaccattcccgatcccagaggtgcatttcaggattcattctatttcatcagagacggggtcttcctgtgttgcccaggctggtctcgaactcctgggctgaagcaatcttcctgccttggcctcccagagggttggaattgcagatgtgaggtgtgtcctggaaccctggctgcacccacagatacagccactcctgggcccatgtggatgtaaccttcgagtgccggaatgcctcgtctccatggagaccaaactcaagggcctgactggcccagtctaccgagaccatgagacctgctgtgcccctcggccaggccaacccaaattcttttaaataaaaggcacaagccacagccaca

SEQ ID NO: 286524 - DNA, 4945 bp, Homo sapiens
  misc_feature (1999)..(1999): n is a, c, g, or t
ttctcgccggtcctgcgggtcgctgctcggctgtgggttagcagcaccctgagcggagcggaagagctgcccgccgccgcgtaaccccgaggccgagactcctggcctggcctccttgggcccacgacgcctgccccgcggagcggacccatgggcctgaggtttgtgtgcggggcctcaggcgagcgctggcgcagcctgtcccccatcgtctgcgccctgcgggcctggccctccccgtggaaggaccgcgggcttcggggccccacgctggggggctgactcctgccacacacacagcggtggccgcgggcctggggcggcagcacagccattctgctcgggctgcgtgagctgaccccgctctctgtgcacctacttttgctgcgtttggtgctgagcctgaagtcccaggacaggcggctgagggggaaagatggtgtgaattgggtgggcagagacaactgaaagccacaggacccggttggcacctttttggccgcctgcgcctttgcctgcagccccgctccctgggtcacccgaaggaggagctggcgctctttccgggcgcagaagcacccgacccacgctggaggaaacggtccctctgggcaggagaagctttgggcctggctggagcacactcacggaaccacgccaacgcctggcctgtagccagctcccacctcccctcccaccttctaaaatgcttgcggatctcacgtggccgaccctaaccagatacacatggggaaaggaatcaggtggcacacataccgcctttactccatagagaacttccaattgtgggtaagaacaaagccccacctctgcctaatagatgcagttttccacctgcagccaaaaagacaacctgttattagcttttttcccagaggacaggcatctctatgaaactgccattgcaaaatttgccgacagtgagataaccagctccattttgcttctaacctccatgccctccttgtttactgctgcacgcaggttgaactgtgggaggaacttagtttaaaacaaagatgataacagccctttcccaaaggaaacctttcctggggattagcctgcttttgtgggaccaacagattagccacaagattagaaactacggttgaagagtcacgcagcgggaggctacaggattctgaccctccccaaactgctcctggcgataacatcaccatcgtaaagcctaagatcagcacttggtgggtcacctggcaccacccaggctcatctgatgttgtggcacccaggaactgactcagtgcgaaaacagcttcgactccctgtgatttcatctctgacctgaccaatgggtacttctgactcactggctgccccccacccaccagcttatctttaaaaactccaaaccccagatgctcagggagaccgagtaataataaaactccagtctcccacacagctagctctgcgtgaattaccttttctctgttgcaaatgccctttcttgataaattggctgtctaggtaacagggaaggtgaacccactgggcagttacacttttatccacccttccagctggatcacgcgccctcttcaatgacatgacacgcagctagagtgtatgagcttgctgccggcaccttccgtcctggatcgcatagcaaggcctcaatggacagccaggtgcctggtccggtcccacttttttttctgtcctgttctcgtttcctctttgcttggccaaagagggttgggccagggtcctgagtgcaagggcttggcttggtgaattaaagtggcagtagccgtgtggcagagaaaatttgtagatgggtgaaatcctgggcctacacagtgacaaagtgtatatagacagccagcctagttggtggatgtgacaaccccagactcttctagatttgtggatccgtgcacctgccagacctgtctctgagccatctggggaggctgggtaagatttcccccgtcagggcctgagcctcatntccaagctgctggcttcagcccagctgccaccagcgctgtctctgtcttgcgctttccagagagagactgactcattttgagctccaggcctaccaggcagcccaaccgcggcagtaactgcctctcacactgaggatggctcatgctctggtccagccatggcttgaacacctcccaacaagaacaaagccagactcattctccctagcatcttcttccttgctcaaagatcccacaccccgttagaagctggaactgggtccttgtcaccttcctcacctccccagtcgtagtctggttaatccttacatctcaccacggtcaccgtggctagatgtgacctccgcgatgcttcaggcacgtactagggcagcctgggcagggctggtcactgtgatctcatgaggtgtgaacttgaccccggccttctttcctgggatgccggctaaggacacaagttcagtgtttgccctggcttgtagcccagcgggggctccgtcatcccctggggaatgcctcggcctgcaagaccgcataccgcattggaacagggaaaccacctacttcagcacctccctcagcaaggtggcaggtcccaacaagccttgcaccacgaggaagtggcagtggcattcgggatatggctccctggccagcttgtgaagttcaaggggctcgttacttcttacagctcacagtccctcccgggtccagcacacctgagggctgacctccctcttgattagtgcaggggaaaagcactttaaaaagctgtgtcatgcgtaacttgcacatcttctgattctgacctgaaactgcatcccaggtcggcacagacgcaacccagtctcctcccacctccgagagtgcagtgtcctgaatggagaaccccagcacccagaagcatccactgaaggactaaattctacacatgaaggcaaacgtccgtggttgacagaaattacactggccagaatccccagtccccatgaggcttgtccagacgcagtgaaccagtcgcagctgataacacacagaccattcccgatcccagaggtgcatttcaggattcattctatttcatcagagacggggtcttcctgtgttgcccaggctggtctcgaactcctgggctgaagcaatcttcctgccttggcctcccagagggttggaattgcagatgtgaggtgtgtcctggaaccctggctgcacccacagatacagccactcctgggcccatgtggatgtaaccttcgagtgccggaatgcctcgtctccatggagaccaaactcaagggcctgactggcccagtctaccgagaccatgagacctgctgtgcccctcggccaggccaacccaaattcttttaaataaaaggcacaagccacagccacaccagcaggaagtggatacaggataaggggcagggctcacatctcatcctcatcagcctttgaccaggcgacggagtctgtgatagctagcttatctgctctatgctccagggacctggccggaacgagccgagttgctgtcctcatggaactctcatcctagtggggcagagacaaggacggtgtaacgtgcccgggggtcagcaccacagacaaaacgcagggagcacggcacagtgtgggccagggaaggcctggcttcccaagggtgtgggcgcgagcagcatggctgtggggagttccaggtgcagagaactactccagagacgaagccaggcctgcgaggaggccggagcgcatgaggggaaggcacgaggcaaggctgccagggctgtgctggtggtgcgggacggtcctgtgggggtagctgcggagatggcactgatgccttcggctccagcagcatcctgggctggtgcgggccaataaggggcagggttggggcaggatgaaaggcacaagccacagccatgtcaagcaggaagtggatgcagggtacagcctgtcagggtcagggtgaaaggcagggaggcgggtaggccataggtgaatttggagcagcctgtagaggacaggatgtgccatcaaagacttgttcttgggtccagctgagactgtcccttggggcttcctgtcaccttgtgcaggatagtgagaccatccttggaaaacccatcgggactgcagagcgcggctcagagctgactgtccaggcctggcaggggctgacccctgggcgctggtgcaccctccgtgcggcctcttggaggaagcacacaaggcgacagttcccagctgccgcctgagatgcagcatctgctttactccagcccagcactgctcaccgtcactgcccactcttatgattttacttcccttcatatttgtgattttgcaaagatggtgttgacttacagctgcagcatcaaatgactgactgccaccagcttggccccagctcagggacatgtctgagcccaggcagagcaccctagtggccgggaagcctcacctggagctcctgcgggtggctgcagtccgccaggtgatccgtgaggagggcttggagaggccccatgatggcgtggaaggatggcagggacccgtacatgagcacgcagcgcttcagcagggccaggcccacagccaggcaggacagtctgtgagggcaggaggcaagaggaggtccaacttgttctgtttgtcactgacaaaaccaataacgtggcaaaaatgaacttccccacttccactaggctgaaaactccagtgtggccaccttggccggccagggttgggcccatgcaaccacgggcaaggcaggctcagggtcaggcctaacgcaggaggggaggctgtgggaaccgcagcgccagctgggatggggcggctccatttttggttccaaattatgatttgtgaaatcaagcaaatgtattttgaaaatgaaaagaaaaagggacagcaagccaacatgcctcagaaaggct

SEQ ID NO: 286525 - DNA, 4677 bp, Homo sapiens
  misc_feature (1999)..(1999): n is a, c, g, or t
ttctcgccggtcctgcgggtcgctgctcggctgtgggttagcagcaccctgagcggagcggaagagctgcccgccgccgcgtaaccccgaggccgagactcctggcctggcctccttgggcccacgacgcctgccccgcggagcggacccatgggcctgaggtttgtgtgcggggcctcaggcgagcgctggcgcagcctgtcccccatcgtctgcgccctgcgggcctggccctccccgtggaaggaccgcgggcttcggggccccacgctggggggctgactcctgccacacacacagcggtggccgcgggcctggggcggcagcacagccattctgctcgggctgcgtgagctgaccccgctctctgtgcacctacttttgctgcgtttggtgctgagcctgaagtcccaggacaggcggctgagggggaaagatggtgtgaattgggtgggcagagacaactgaaagccacaggacccggttggcacctttttggccgcctgcgcctttgcctgcagccccgctccctgggtcacccgaaggaggagctggcgctctttccgggcgcagaagcacccgacccacgctggaggaaacggtccctctgggcaggagaagctttgggcctggctggagcacactcacggaaccacgccaacgcctggcctgtagccagctcccacctcccctcccaccttctaaaatgcttgcggatctcacgtggccgaccctaaccagatacacatggggaaaggaatcaggtggcacacataccgcctttactccatagagaacttccaattgtgggtaagaacaaagccccacctctgcctaatagatgcagttttccacctgcagccaaaaagacaacctgttattagcttttttcccagaggacaggcatctctatgaaactgccattgcaaaatttgccgacagtgagataaccagctccattttgcttctaacctccatgccctccttgtttactgctgcacgcaggttgaactgtgggaggaacttagtttaaaacaaagatgataacagccctttcccaaaggaaacctttcctggggattagcctgcttttgtgggaccaacagattagccacaagattagaaactacggttgaagagtcacgcagcgggaggctacaggattctgaccctccccaaactgctcctggcgataacatcaccatcgtaaagcctaagatcagcacttggtgggtcacctggcaccacccaggctcatctgatgttgtggcacccaggaactgactcagtgcgaaaacagcttcgactccctgtgatttcatctctgacctgaccaatgggtacttctgactcactggctgccccccacccaccagcttatctttaaaaactccaaaccccagatgctcagggagaccgagtaataataaaactccagtctcccacacagctagctctgcgtgaattaccttttctctgttgcaaatgccctttcttgataaattggctgtctaggtaacagggaaggtgaacccactgggcagttacacttttatccacccttccagctggatcacgcgccctcttcaatgacatgacacgcagctagagtgtatgagcttgctgccggcaccttccgtcctggatcgcatagcaaggcctcaatggacagccaggtgcctggtccggtcccacttttttttctgtcctgttctcgtttcctctttgcttggccaaagagggttgggccagggtcctgagtgcaagggcttggcttggtgaattaaagtggcagtagccgtgtggcagagaaaatttgtagatgggtgaaatcctgggcctacacagtgacaaagtgtatatagacagccagcctagttggtggatgtgacaaccccagactcttctagatttgtggatccgtgcacctgccagacctgtctctgagccatctggggaggctgggtaagatttcccccgtcagggcctgagcctcatntccaagctgctggcttcagcccagctgccaccagcgctgtctctgtcttgcgctttccagagagagactgactcattttgagctccaggcctaccaggcagcccaaccgcggcagtaactgcctctcacactgaggatggctcatgctctggtccagccatggcttgaacacctcccaacaagaacaaagccagactcattctccctagcatcttcttccttgctcaaagatcccacaccccgttagaagctggaactgggtccttgtcaccttcctcacctccccagtcgtagtctggttaatccttacatctcaccacggtcaccgtggctagatgtgacctccgcgatgcttcaggcacgtactagggcagcctgggcagggctggtcactgtgatctcatgaggtgtgaacttgaccccggccttctttcctgggatgccggctaaggacacaagttcagtgtttgccctggcttgtagcccagcgggggctccgtcatcccctggggaatgcctcggcctgcaagaccgcataccgcattggaacagggaaaccacctacttcagcacctccctcagcaaggtggcaggtcccaacaagccttgcaccacgaggaagtggcagtggcattcgggatatggctccctggccagcttgtgaagttcaaggggctcgttacttcttacagctcacagtccctcccgggtccagcacacctgagggctgacctccctcttgattagtgcaggggaaaagcactttaaaaagctgtgtcatgcgtaacttgcacatcttctgattctgacctgaaactgcatcccaggtcggcacagacgcaacccagtctcctcccacctccgagagtgcagtgtcctgaatggagaaccccagcacccagaagcatccactgaaggacgtgtgtcctggaaccctggctgcacccacagatacagccactcctgggcccatgtggatgtaaccttcgagtgccggaatgcctcgtctccatggagaccaaactcaagggcctgactggcccagtctaccgagaccatgagacctgctgtgcccctcggccaggccaacccaaattcttttaaataaaaggcacaagccacagccacaccagcaggaagtggatacaggataaggggcagggctcacatctcatcctcatcagcctttgaccaggcgacggagtctgtgatagctagcttatctgctctatgctccagggacctggccggaacgagccgagttgctgtcctcatggaactctcatcctagtggggcagagacaaggacggtgtaacgtgcccgggggtcagcaccacagacaaaacgcagggagcacggcacagtgtgggccagggaaggcctggcttcccaagggtgtgggcgcgagcagcatggctgtggggagttccaggtgcagagaactactccagagacgaagccaggcctgcgaggaggccggagcgcatgaggggaaggcacgaggcaaggctgccagggctgtgctggtggtgcgggacggtcctgtgggggtagctgcggagatggcactgatgccttcggctccagcagcatcctgggctggtgcgggccaataaggggcagggttggggcaggatgaaaggcacaagccacagccatgtcaagcaggaagtggatgcagggtacagcctgtcagggtcagggtgaaaggcagggaggcgggtaggccataggtgaatttggagcagcctgtagaggacaggatgtgccatcaaagacttgttcttgggtccagctgagactgtcccttggggcttcctgtcaccttgtgcaggatagtgagaccatccttggaaaacccatcgggactgcagagcgcggctcagagctgactgtccaggcctggcaggggctgacccctgggcgctggtgcaccctccgtgcggcctcttggaggaagcacacaaggcgacagttcccagctgccgcctgagatgcagcatctgctttactccagcccagcactgctcaccgtcactgcccactcttatgattttacttcccttcatatttgtgattttgcaaagatggtgttgacttacagctgcagcatcaaatgactgactgccaccagcttggccccagctcagggacatgtctgagcccaggcagagcaccctagtggccgggaagcctcacctggagctcctgcgggtggctgcagtccgccaggtgatccgtgaggagggcttggagaggccccatgatggcgtggaaggatggcagggacccgtacatgagcacgcagcgcttcagcagggccaggcccacagccaggcaggacagtctgtgagggcaggaggcaagaggaggtccaacttgttctgtttgtcactgacaaaaccaataacgtggcaaaaatgaacttccccacttccactaggctgaaaactccagtgtggccaccttggccggccagggttgggcccatgcaaccacgggcaaggcaggctcagggtcaggcctaacgcaggaggggaggctgtgggaaccgcagcgccagctgggatggggcggctccatttttggttccaaattatgatttgtgaaatcaagcaaatgtattttgaaaatgaaaagaaaaagggacagcaagccaacatgcctcagaaaggct

SEQ ID NO: 286526 - DNA, 3001 bp, Homo sapiens
  misc_feature (1999)..(1999): n is a, c, g, or t
ttctcgccggtcctgcgggtcgctgctcggctgtgggttagcagcaccctgagcggagcggaagagctgcccgccgccgcgtaaccccgaggccgagactcctggcctggcctccttgggcccacgacgcctgccccgcggagcggacccatgggcctgaggtttgtgtgcggggcctcaggcgagcgctggcgcagcctgtcccccatcgtctgcgccctgcgggcctggccctccccgtggaaggaccgcgggcttcggggccccacgctggggggctgactcctgccacacacacagcggtggccgcgggcctggggcggcagcacagccattctgctcgggctgcgtgagctgaccccgctctctgtgcacctacttttgctgcgtttggtgctgagcctgaagtcccaggacaggcggctgagggggaaagatggtgtgaattgggtgggcagagacaactgaaagccacaggacccggttggcacctttttggccgcctgcgcctttgcctgcagccccgctccctgggtcacccgaaggaggagctggcgctctttccgggcgcagaagcacccgacccacgctggaggaaacggtccctctgggcaggagaagctttgggcctggctggagcacactcacggaaccacgccaacgcctggcctgtagccagctcccacctcccctcccaccttctaaaatgcttgcggatctcacgtggccgaccctaaccagatacacatggggaaaggaatcaggtggcacacataccgcctttactccatagagaacttccaattgtgggtaagaacaaagccccacctctgcctaatagatgcagttttccacctgcagccaaaaagacaacctgttattagcttttttcccagaggacaggcatctctatgaaactgccattgcaaaatttgccgacagtgagataaccagctccattttgcttctaacctccatgccctccttgtttactgctgcacgcaggttgaactgtgggaggaacttagtttaaaacaaagatgataacagccctttcccaaaggaaacctttcctggggattagcctgcttttgtgggaccaacagattagccacaagattagaaactacggttgaagagtcacgcagcgggaggctacaggattctgaccctccccaaactgctcctggcgataacatcaccatcgtaaagcctaagatcagcacttggtgggtcacctggcaccacccaggctcatctgatgttgtggcacccaggaactgactcagtgcgaaaacagcttcgactccctgtgatttcatctctgacctgaccaatgggtacttctgactcactggctgccccccacccaccagcttatctttaaaaactccaaaccccagatgctcagggagaccgagtaataataaaactccagtctcccacacagctagctctgcgtgaattaccttttctctgttgcaaatgccctttcttgataaattggctgtctaggtaacagggaaggtgaacccactgggcagttacacttttatccacccttccagctggatcacgcgccctcttcaatgacatgacacgcagctagagtgtatgagcttgctgccggcaccttccgtcctggatcgcatagcaaggcctcaatggacagccaggtgcctggtccggtcccacttttttttctgtcctgttctcgtttcctctttgcttggccaaagagggttgggccagggtcctgagtgcaagggcttggcttggtgaattaaagtggcagtagccgtgtggcagagaaaatttgtagatgggtgaaatcctgggcctacacagtgacaaagtgtatatagacagccagcctagttggtggatgtgacaaccccagactcttctagatttgtggatccgtgcacctgccagacctgtctctgagccatctggggaggctgggtaagatttcccccgtcagggcctgagcctcatntccaagctgctggcttcagcccagctgccaccagcgctgtctctgtcttgcgctttccagagagagactgactcattttgagctccaggcctaccaggcagcccaaccgcggcagtaactgcctctcacactgaggatggctcatgctctggtccagccatggcttgaacacctcccaacaagaacaaagccagactcattctccctagcatcttcttccttgctcaaagatcccacaccccgttagaagctggaactgggtccttgtcaccttcctcacctccccagtcgtagtctggttaatccttacatctcaccacggtcaccgtggctagatgtgacctccgcgatgcttcaggcacgtactagggcagcctgggcagggctggtcactgtgatctcatgaggtgtgaacttgaccccggccttctttcctgggatgccggctaaggacacaagttcagtgtttgccctggcttgtagcccagcgggggctccgtcatcccctggggaatgcctcggcctgcaagaccgcataccgcattggaacagggaaaccacctacttcagcacctccctcagcaaggtggcaggtcccaacaagccttgcaccacgaggaagtggcagtggcattcgggatatggctccctggccagcttgtgaagttcaaggggctcgttacttcttacagctcacagtccctcccgggtccagcacacctgagggctgacctccctcttgattagtgcaggggaaaagcactttaaaaagctgtgtcatgcgtaacttgcacatcttctgattctgacctgaaactgcatcccaggtcggcacagacgcaacccagtctcctcccacctccgagagtgcagtgtcctgaatggagaaccccagcacccagaagcatccactgaaggactaaattctacacatgaaggcaaacgtccgtggttgacagaaattacactggcctacagcacatgcggtacgagctcgattct

SEQ ID NO: 286527 - DNA, 3836 bp, Homo sapiens
  misc_feature (1999)..(1999): n is a, c, g, or t
ttctcgccggtcctgcgggtcgctgctcggctgtgggttagcagcaccctgagcggagcggaagagctgcccgccgccgcgtaaccccgaggccgagactcctggcctggcctccttgggcccacgacgcctgccccgcggagcggacccatgggcctgaggtttgtgtgcggggcctcaggcgagcgctggcgcagcctgtcccccatcgtctgcgccctgcgggcctggccctccccgtggaaggaccgcgggcttcggggccccacgctggggggctgactcctgccacacacacagcggtggccgcgggcctggggcggcagcacagccattctgctcgggctgcgtgagctgaccccgctctctgtgcacctacttttgctgcgtttggtgctgagcctgaagtcccaggacaggcggctgagggggaaagatggtgtgaattgggtgggcagagacaactgaaagccacaggacccggttggcacctttttggccgcctgcgcctttgcctgcagccccgctccctgggtcacccgaaggaggagctggcgctctttccgggcgcagaagcacccgacccacgctggaggaaacggtccctctgggcaggagaagctttgggcctggctggagcacactcacggaaccacgccaacgcctggcctgtagccagctcccacctcccctcccaccttctaaaatgcttgcggatctcacgtggccgaccctaaccagatacacatggggaaaggaatcaggtggcacacataccgcctttactccatagagaacttccaattgtgggtaagaacaaagccccacctctgcctaatagatgcagttttccacctgcagccaaaaagacaacctgttattagcttttttcccagaggacaggcatctctatgaaactgccattgcaaaatttgccgacagtgagataaccagctccattttgcttctaacctccatgccctccttgtttactgctgcacgcaggttgaactgtgggaggaacttagtttaaaacaaagatgataacagccctttcccaaaggaaacctttcctggggattagcctgcttttgtgggaccaacagattagccacaagattagaaactacggttgaagagtcacgcagcgggaggctacaggattctgaccctccccaaactgctcctggcgataacatcaccatcgtaaagcctaagatcagcacttggtgggtcacctggcaccacccaggctcatctgatgttgtggcacccaggaactgactcagtgcgaaaacagcttcgactccctgtgatttcatctctgacctgaccaatgggtacttctgactcactggctgccccccacccaccagcttatctttaaaaactccaaaccccagatgctcagggagaccgagtaataataaaactccagtctcccacacagctagctctgcgtgaattaccttttctctgttgcaaatgccctttcttgataaattggctgtctaggtaacagggaaggtgaacccactgggcagttacacttttatccacccttccagctggatcacgcgccctcttcaatgacatgacacgcagctagagtgtatgagcttgctgccggcaccttccgtcctggatcgcatagcaaggcctcaatggacagccaggtgcctggtccggtcccacttttttttctgtcctgttctcgtttcctctttgcttggccaaagagggttgggccagggtcctgagtgcaagggcttggcttggtgaattaaagtggcagtagccgtgtggcagagaaaatttgtagatgggtgaaatcctgggcctacacagtgacaaagtgtatatagacagccagcctagttggtggatgtgacaaccccagactcttctagatttgtggatccgtgcacctgccagacctgtctctgagccatctggggaggctgggtaagatttcccccgtcagggcctgagcctcatntccaagctgctggcttcagcccagctgccaccagcgctgtctctgtcttgcgctttccagagagagactgactcattttgagctccaggcctaccaggcagcccaaccgcggcagtaactgcctctcacactgaggatggctcatgctctggtccagccatggcttgaacacctcccaacaagaacaaagccagactcattctccctagcatcttcttccttgctcaaagatcccacaccccgttagaagctggaactgggtccttgtcaccttcctcacctccccagtcgtagtctggttaatccttacatctcaccacggtcaccgtggctagatgtgacctccgcgatgcttcaggcacgtactagggcagcctgggcagggctggtcactgtgatctcatgaggtgtgaacttgaccccggccttctttcctgggatgccggctaaggacacaagttcagtgtttgccctggcttgtagcccagcgggggctccgtcatcccctggggaatgcctcggcctgcaagaccgcataccgcattggaacagggaaaccacctacttcagcacctccctcagcaaggtggcaggtcccaacaagccttgcaccacgaggaagtggcagtggcattcgggatatggctccctggccagcttgtgaagttcaaggggctcgttacttcttacagctcacagtccctcccgggtccagcacacctgagggctgacctccctcttgattagtgcaggggaaaagcactttaaaaagctgtgtcatgcgtaacttgcacatcttctgattctgacctgaaactgcatcccaggtcggcacagacgcaacccagtctcctcccacctccgagagtgcagtgtcctgaatggagaaccccagcacccagaagcatccactgaaggacgtaagtaggacaaggccaactgtggctgttccagcagagggactgtgggtgatgtttcccttctctgatttctaaaatatctgcaaacttgtttcatttataattgaaaatataatttgcataacaacagtaaattctacacatgaaggcaaacgtccgtggttgacagaaattacactggccagaatccccagtccccatgaggcttgtccagacgcagtgaaccagtcgcagctgataacacacagaccattcccgatcccagaggtgcatttcaggattcattctatttcatcagagacggggtcttcctgtgttgcccaggctggtctcgaactcctgggctgaagcaatcttcctgccttggcctcccagagggttggaattgcagatgtgaggtacttctttgatagtgcctccatgcatgcagaagatgacgtggagagctccgcgcggcacagggcaggaagctggtgtgcactctcatggatccgaagccaacacacgcctctcaactgaggactctgcccctctggcattcttccagccaccagccctgggggccaggagccactgagtgggtcacacagccttagagggcaacgagggcaggagctcgccctggcggtccccatgcagacaagaggtacacactccctggcatgcagagccacccaactgggtttcactgaagggtgaggggcggggtgtctaccgtgctttccaaataccgctcagtcacccagagcttgaaacttacaatgagccaccccatcccagccacaaatctaaaggggttcacttgtttcaaaatcaacttgtttgtggttaaaagtcagtcccagctctacagtggctggagcggcacgtgtgagaagccggcttgcgctgtgaggctcacaagccctgggtgacca

SEQ ID NO: 286528 - DNA, 3228 bp, Homo sapiens
  misc_feature (1999)..(1999): n is a, c, g, or t
ttctcgccggtcctgcgggtcgctgctcggctgtgggttagcagcaccctgagcggagcggaagagctgcccgccgccgcgtaaccccgaggccgagactcctggcctggcctccttgggcccacgacgcctgccccgcggagcggacccatgggcctgaggtttgtgtgcggggcctcaggcgagcgctggcgcagcctgtcccccatcgtctgcgccctgcgggcctggccctccccgtggaaggaccgcgggcttcggggccccacgctggggggctgactcctgccacacacacagcggtggccgcgggcctggggcggcagcacagccattctgctcgggctgcgtgagctgaccccgctctctgtgcacctacttttgctgcgtttggtgctgagcctgaagtcccaggacaggcggctgagggggaaagatggtgtgaattgggtgggcagagacaactgaaagccacaggacccggttggcacctttttggccgcctgcgcctttgcctgcagccccgctccctgggtcacccgaaggaggagctggcgctctttccgggcgcagaagcacccgacccacgctggaggaaacggtccctctgggcaggagaagctttgggcctggctggagcacactcacggaaccacgccaacgcctggcctgtagccagctcccacctcccctcccaccttctaaaatgcttgcggatctcacgtggccgaccctaaccagatacacatggggaaaggaatcaggtggcacacataccgcctttactccatagagaacttccaattgtgggtaagaacaaagccccacctctgcctaatagatgcagttttccacctgcagccaaaaagacaacctgttattagcttttttcccagaggacaggcatctctatgaaactgccattgcaaaatttgccgacagtgagataaccagctccattttgcttctaacctccatgccctccttgtttactgctgcacgcaggttgaactgtgggaggaacttagtttaaaacaaagatgataacagccctttcccaaaggaaacctttcctggggattagcctgcttttgtgggaccaacagattagccacaagattagaaactacggttgaagagtcacgcagcgggaggctacaggattctgaccctccccaaactgctcctggcgataacatcaccatcgtaaagcctaagatcagcacttggtgggtcacctggcaccacccaggctcatctgatgttgtggcacccaggaactgactcagtgcgaaaacagcttcgactccctgtgatttcatctctgacctgaccaatgggtacttctgactcactggctgccccccacccaccagcttatctttaaaaactccaaaccccagatgctcagggagaccgagtaataataaaactccagtctcccacacagctagctctgcgtgaattaccttttctctgttgcaaatgccctttcttgataaattggctgtctaggtaacagggaaggtgaacccactgggcagttacacttttatccacccttccagctggatcacgcgccctcttcaatgacatgacacgcagctagagtgtatgagcttgctgccggcaccttccgtcctggatcgcatagcaaggcctcaatggacagccaggtgcctggtccggtcccacttttttttctgtcctgttctcgtttcctctttgcttggccaaagagggttgggccagggtcctgagtgcaagggcttggcttggtgaattaaagtggcagtagccgtgtggcagagaaaatttgtagatgggtgaaatcctgggcctacacagtgacaaagtgtatatagacagccagcctagttggtggatgtgacaaccccagactcttctagatttgtggatccgtgcacctgccagacctgtctctgagccatctggggaggctgggtaagatttcccccgtcagggcctgagcctcatntccaagctgctggcttcagcccagctgccaccagcgctgtctctgtcttgcgctttccagagagagactgactcattttgagctccaggcctaccaggcagcccaaccgcggcagtaactgcctctcacactgaggatggctcatgctctggtccagccatggcttgaacacctcccaacaagaacaaagccagactcattctccctagcatcttcttccttgctcaaagatcccacaccccgttagaagctggaactgggtccttgtcaccttcctcacctccccagtcgtagtctggttaatccttacatctcaccacggtcaccgtggctagatgtgacctccgcgatgcttcaggcacgtactagggcagcctgggcagggctggtcactgtgatctcatgaggtgtgaacttgaccccggccttctttcctgggatgccggctaaggacacaagttcagtgtttgccctggcttgtagcccagcgggggctccgtcatcccctggggaatgcctcggcctgcaagaccgcataccgcattggaacagggaaaccacctacttcagcacctccctcagcaaggtggcaggtcccaacaagccttgcaccacgaggaagtggcagtggcattcgggatatggctccctggccagcttgtgaagttcaaggggctcgttacttcttacagctcacagtccctcccgggtccagcacacctgagggctgacctccctcttgattagtgcaggggaaaagcactttaaaaagctgtgtcatgcgtaacttgcacatcttctgattctgacctgaaactgcatcccaggtcggcacagacgcaacccagtctcctcccacctccgagagtgcagtgtcctgaatggagaaccccagcacccagaagcatccactgaaggacagacggggtcttcctgtgttgcccaggctggtctcgaactcctgggctgaagcaatcttcctgccttggcctcccagagggttggaattgcagatgtgaggtgtgtcctggaaccctggctgcacccacagatacagccactcctgggcccatgtggatgtaaccttcgagtgccggaatgcctcgtctccatggagaccaaactcaagggcctgactggcccagtctaccgagaccatgagacctgctgtgcccctcggccaggccaacccaaattcttttaaataaaaggcacaagccacagccaca

SEQ ID NO: 286529 - DNA, 2009 bp, Homo sapiens
ttctcgccggtcctgcgggtcgctgctcggctgtgggttagcagcaccctgagcggagcggaagagctgcccgccgccgcgtaaccccgaggccgagactcctggcctggcctccttgggcccacgacgcctgccccgcggagcggacccatgggcctgaggtttgtgtgcggggcctcaggcgagcgctggcgcagcctgtcccccatcgtctgcgccctgcgggcctggccctccccgtggaaggaccgcgggcttcggggccccacgctggggggctgactcctgccacacacacagcggtggccgcgggcctggggcggcagcacagccattctgctcgggctgcgtgagctgaccccgctctctgtgcacctacttttgctgcgtttggtgctgagcctgaagtcccaggacaggcggctgagggggaaagatggtgtgaattgggtgggcagagacaactgaaagccacaggacccggttggcacctttttggccgcctgcgcctttgcctgcagccccgctccctgggtcacccgaaggaggagctggcgctctttccgggcgcagaagcacccgacccacgctggaggaaacggtccctctgggcaggagaagctttgggcctggctggagcacactcacggaaccacgccaacgcctggcctgtagccagctcccacctcccctcccaccttctaaaatgcttgcggatctcacgtggccgaccctaaccagatacacatggggaaaggaatcaggtggcacacataccgcctttactccatagagaacttccaattgtgggtaagaacaaagccccacctctgcctaatagatgcagttttccacctgcagccaaaaagacaacctgttattagcttttttcccagaggacaggcatctctatgaaactgccattgcaaaatttgccgacagtgagataaccagctccattttgcttctaacctccatgccctccttgtttactgctgcacgcaggttgaactgtgggaggaacttagtttaaaacaaagatgataacagccctttcccaaaggaaacctttcctggggattagcctgcttttgtgggaccaacagattagccacaagattagaaactacggttgaagagtcacgcagcgggaggctacaggattctgaccctccccaaactgctcctggcgataacatcaccatcgtaaagcctaagatcagcacttggtgggtcacctggcaccacccaggctcatctgatgttgtggcacccaggaactgactcagtgcgaaaacagcttcgactccctgtgatttcatctctgacctgaccaatgggtacttctgactcactggctgccccccacccaccagcttatctttaaaaactccaaaccccagatgctcagggagaccgagtaataataaaactccagtctcccacacagctagctctgcgtgaattaccttttctctgttgcaaatgccctttcttgataaattggctgtctaggtaacagggaaggtgaacccactgggcagttacacttttatccacccttccagctggatcacgcgccctcttcaatgacatgacacgcagctagagtgtatgagcttgctgccggcaccttccgtcctggatcgcatagcaaggcctcaatggacagccaggtgcctggtccggtcccacttttttttctgtcctgttctcgtttcctctttgcttggccaaagagggttgggccaggtgtcctgaatggagaaccccagcacccagaagcatccactgaaggacgtgtgtcctggaaccctggctgcacccacagatacagccactcctgggcccatgtggatgtaaccttcgagtgccggaatgcctcgtctccatggagaccaaactcaagggcctgactggcccagtctaccgagaccatgagacctgctgtgcccctcggccaggccaacccaaattcttttaaataaaaggcacaagccacagccaca

SEQ ID NO: 286530 - DNA, 1535 bp, Homo sapiens
  misc_feature (1510)..(1510): n is a, c, g, or t
gattcaggaaacatctggcaaagatgatataagtgcctgttaagcagaaatgtaaagtcaggagagaatgactttagataagaaacacagaaaagccctgcaagccactttcctatgcagtcacctgttgactgagcaagtaagaactggatgaatccgctttttctaacagcattcttaagagtctacactcacttctgccatttcctaaaaactcagccataacattatggactggaggtggtgggagaaacagctcgatttgtggtacagacgttgttgggggcaccactctgtgtggcagctgcagctgacagctccaaggcactttccatattaactcatttattcctcacgacaggtacttctttgatagtgcctccatgcatgcagaagatgacgtggagagctccgcgcggcacagggcaggaagctggtgtgcactctcatggatccgaagccaacacacgcctctcaactgaggactctgcccctctggcattcttccagccaccagccctgggggccaggagccactgagtgggtcacacagccttagagggcaacgagggcaggagctcgccctggcggtccccatgcagacaagagggtcactggcttccttgctttgctcttcctggacatcttcctcgacattcatctttccatcctaccaagagcgtggaaaccacagggcatgaggacaggcggagacaacgctggaccatctcacagccacatcaagaggctgcccacatcagggctttctacgtggttgcaaggaacacaaacctgtgtgctccatttgcccactggcactaggcctcctgcccaccacccgcttctaggctattcgagccgcaggagctacaggctgctagagaaccctgcggcaggatgctgggcgcggttcagcttttgccagggagcagcatgggactgggatttggaaggtgtacagtggctgcgggctttagcaggaggagtgtctacagcaccttctgctcctccaggtaacctagtgtttttatcagtatccattttcctgtgtggatctcttctgcttgaaacctgtcctgcctatttttcttccctggaccctgactgatacactcttaaaacgagaaaagggtaccgatttataaagttcgtgaattaaaaactacaccagtcatggaaactcaatgacatcactcaaagaaaattcacaactctagccttgagttagctccctcaatagtatgatgaggtcatgcagatagaatcatacagttattaacaaaagtagttgatgttaaccgagtaatcagttttatctgtgttcctttgagacagagagagagagtgagaaagagagcgtgagcaagtgagtgcacatactattgttaaagtcttctctctaaagttttaatatctgatataccataaacacccagataaagaactttagagaaactggttaaaaagatttaaaattcccaactgtaataaatccctaaaatgaataccnaaaaaatgtttttaaattaaaaaaa

SEQ ID NO: 286531 - DNA, 521 bp, Homo sapiens
gctacctgtggggagggccccagaggtggaagtgagactttttattgcatatttttaatactttctcaattctgaaccacatgaatacattaacaattttttttaagttttttttttaaggtgagttgaagtcttgggaatagactgaaaactaacaaaaccggccccatcgctgaggaccaggtgagcctcttcagaatgcatcatttccacccatactaaatgactacatcatctctttggacatcccaattcacaaaagtctgaagtagttcccagtaactgcagggttcttgaccatttcaatgtcctctgtccacaggatgggacaaaaacaagggcagatgctgtagtctgcaagctcatatcctcaaagagaccaaaatgccatttataattttactgtcatattcactgcagccatgttatttaaatagtcattacagaatcatgaaaataaccacaagaacttttaagtgtgaaataaaggtctcataaatttctgttccttaaaacccaaa

SEQ ID NO: 286532 - DNA, 785 bp, Homo sapiens
atgggaatgtattcatacacagcctgagcagctgagcaggtgctggactgcacaaggcaagaggggaagctgggcctcaccagagaattccaagttcaagttccaagtcgcaccagatgatggcgagcctcataagagctgggactgaatataaaaaggtgagaggccaccaccttctccacatgcctggtcctgggcttcttggctcgttttgttttgctctacattaaaaggtcagttgagagaaaatgaggaagtcaaaacaaaggctcctggcgtctggcaggagctgccgaaaggtggctgatgcaatctccccgaggagccacattaatttttaaaaaggcagctgttttcaaagcaaaacgtttaataattttttttggaaccccagtgtaacagaattcaaatgggaaaagtgagagggagtgtttaaacaaaggcatccccaagtcccttcccagttggtcctgaacaatggaggaggtcaaaccttcttttccacagcatgatggtataaatcagggaagtcctggaaatctattccacaccctaaaatacccaaacccattaaaagcacagatataggcttttacaaacatttactaaataagcaaaaccatacaaaatatgttcccgtcggcaatttttcccataccatggactcaaatggttaaaactccttatcatcccagactaatgccaccttttcaattcccaatgatgcttgttacggaaggaattattgggaattgaaaaggtggcattagtctgggatgataagg

SEQ ID NO: 286533 - DNA, 2601 bp, Homo sapiens
gccccaactcagcccaccatagacactgaggtgctcgctcttttaatgtcctcgttgtggccgtaagtactttgctaggtttcatttaggcatttggcaaatcagcctggaagtctggacccatgacagcaatcactccctccccacctcctgaagctagaggaaggagagctgtttactaggcacgactgcgaaggcaagggggcaccagctcaggactgcatctgcctgccatttcccttccactcctcctttctggagtctgacattagaaagccagcgagaaggaagattcaaacaaccaaccctgatttcctgcttctccttttcatgagtgttcctgtggtctctgcacctcctttctgtcccccggcagagggcagtagagatggccggcccaaggcctcggtggcgcgaccagctgctgttcatgagcatcatagtcctcgtgattgtggtcatctgcctgatgttatacgctcttctctgggaggctggcaacctcactgacctgcccaacctgagaatcggcttctataacttctgcctgtggaatgaggacaccagcaccctacagtgtcaccagttccctgagctggaagccctgggggtgcctcgggttggcctgggcctggccaggcttggcgtgtacgggtccctggtcctcaccctctttgccccccagcctctcctcctagcccagtgcaacagtgatgagagagcgtggcggctggcagtgggcttcctggctgtgtcctctgtgctgctggcaggcggcctgggcctcttcctctcctatgtgtggaagtgggtcaggctctccctcccggggcctgggtttctagctctgggcagcgcccaggccttactcatcctcttgcttatagccatggctgtgttccctctgagggctgagagggctgagagcaagcttgagagctgctaaaggcttacgtgattgcaagggttcagttccaaccatggtcagaggtggcacatctgctcagccatctcattttacagctaacgctgatctccagctccagcgatggaacccactacagaggaggtggggcccctgtgtcaaagaggccgaggggcagcaagggcagccagggcacctgtgacttcttagtacaagattgtctgtccttcaggacttccaaggctcccaaagactccctaaaccatgcagctcattgtcacaccaattcctgctttaattaatggatctgagcaaatcttcctctagcttcaggagggtggggagggagtgattgccgtcatggggccagacttccaggctgatttgccaaatgccaaaatgaaacctagcaaagaacttacggcaacaaacgaggacattaaaagagcgagcacctcagtgtctctggggacatggttaaggagcttccactcagcccaccatagtgagtgggccgccataagccatcactggaactccaaccccagaggtccaggagtgatctctgagtgactcaacaaagacaggacacatggggtacaaagacaaggcttgactgcttcaaagcttccctggacctgaagccagacagggcagaggcgtccgctgacaaatcactcccatgatgagaccctggaggactccaaatcctcgctgtgaacaggactggacggttgcgcacaaacaaacgctgccaccctccacttcccaacccagaacttggaaagacattagcacaacttacgcattggggaattgtgtgtattttctagcacttgtgtattggaaaacctgtatggcagtgatttattcatatattcctgtccaaagccacactgaaaacagaggcagagacatgtactctggtgtgatctcttgtcctcagtgtctcttctgggctcctgtccctcttgctttatagctagctgcccggggaccaaggtacaggtgaaagcaaggtagcagcttgcgggaggaggcctgtctggcttaccagtctatacactgtggcctcaacctcccagacagggcagagaactgtgggcagctcgtttgctttctaggctggctggagaggtgggagctcattgatagactcatgatggaaactatttttgaaacaggcttcctccttcaggagagatcatgcggactaaactgtagcaattccagtgcacctggcagtgatccttttctttgcaaagtactgtctctttggttccagtaagttggaccaccacatgacatcattttccctggaacctggtcactgactaacacagacaattgggactccagagcctcaagagccaggagagggcacagtacatacagagggagtcaaatgggatctcattttgagtcctgccttccgcacactcagaacggcagccccaaggcccggagtgtccaggggcttctggcctgaggtgaatctgccaggcccaagaaggcacaaagaagagtcagggcccaagcttaatgacctgttttttaattcaggaaggtaaatctcgttctctcgtcacacccggaattacaggtccatttgtcctcagtgggagttgatctttgattcccggaactttaagccctgccgtctcgcctggcgccca

SEQ ID NO: 286534 - DNA, 3214 bp, Homo sapiens
ataccccaaaatttaaatcttttttttttttgggacagagtcttactctgttgcccaggctggagagcagtggtccaatctcaactcacggcaaacctccacctcccgggttcaaagtgattctcctgcctcaggaggcagagattgcagtgagccaagatcgcaccactgcactccagcctgggtgacagagtgaggctccatctcaaaacaacaacaaacaaaaacgtctaagttttctataattcatactaccattgtcaggaaaaaatatgtattagtttttaaagtaatgagtatatgatgggatttcatcaccaggtgacatcttgtcttgacccagtaatgagttcccagagcactgcaggtaaaatcagagtgggtgtgtcagtggtccttgacccaggctcaccttcgaatgagcttcagagcttcagaaacacaccagtgcccagcccgaagcacataagttgagctctgattgatctgtggcccagcaatgggtagttcttacagctccccaggtggttgtcttggcagctgtggtgaaaaccaatagcttcctccaccttcaggtctccattaagggtgggccttgcccttcacctcagtcaaaacccaccttcaaaaaagatctgagaaatcccctcactaatgtttccaatggcttgttgtatttggactggagcaaagcctttggctaaagagcacttcactcagtttaagatgtttcacactttcaaagctgcttgggagagacttttcctcctgacctcaaatcagagggcagctaatgacttatttgcaaataggtcctggcaggaggttacctcagacttctggtccttggtggagggcagggtaggagggaaacttgccatgagtttgtaagaaatgccaaagggagaacatgagcttgtctggacacagggaacaagcaagggagagatggactgactgctgtgacttccccgcaggtcccccggcagagggcagtagagatggccggcccaaggcctcggtggcgcgaccagctgctgttcatgagcatcatagtcctcgtgattgtggtcatctgcctgatgttatacgctcttctctgggaggctggcaacctcactgacctgcccaacctgagaatcggcttctataacttctgcctgtggaatgaggacaccagcaccctacagtgtcaccagttccctgagctggaagccctgggggtgcctcgggttggcctgggcctggccaggcttggcgtgtacgggtccctggtcctcaccctctttgccccccagcctctcctcctagcccagtgcaacagtgatgagagagcgtggcggctggcagtgggcttcctggctgtgtcctctgtgctgctggcaggcggcctgggcctcttcctctcctatgtgtggaagtgggtcaggctctccctcccggggcctgggtttctagctctgggcagcgcccaggccttactcatcctcttgcttatagccatggctgtgttccctctgagggctgagagggctgagagcaagcttgagagctgctaaaggcttacgtgattgcaagggttcagttccaaccatggtcagaggtggcacatctgctcagccatctcattttacagctaacgctgatctccagctccagcgatggaacccactacagaggaggtggggcccctgtgtcaaagaggccgaggggcagcaagggcagccagggcacctgtgacttcttagtacaagattgtctgtccttcaggacttccaaggctcccaaagactccctaaaccatgcagctcattgtcacaccaattcctgctttaattaatggatctgagcaaatcttcctctagcttcaggagggtggggagggagtgattgccgtcatggggccagacttccaggctgatttgccaaatgccaaaatgaaacctagcaaagaacttacggcaacaaacgaggacattaaaagagcgagcacctcagtgtctctggggacatggttaaggagcttccactcagcccaccatagtgagtgggccgccataagccatcactggaactccaaccccagaggtccaggagtgatctctgagtgactcaacaaagacaggacacatggggtacaaagacaaggcttgactgcttcaaagcttccctggacctgaagccagacagggcagaggcgtccgctgacaaatcactcccatgatgagaccctggaggactccaaatcctcgctgtgaacaggactggacggttgcgcacaaacaaacgctgccaccctccacttcccaacccagaacttggaaagacattagcacaacttacgcattggggaattgtgtgtattttctagcacttgtgtattggaaaacctgtatggcagtgatttattcatatattcctgtccaaagccacactgaaaacagaggcagagacatgtactctggtgtgatctcttgtcctcagtgtctcttctgggctcctgtccctcttgctttatagctagctgcccggggaccaaggtacaggtgaaagcaaggtagcagcttgcgggaggaggcctgtctggcttaccagtctatacactgtggcctcaacctcccagacagggcagagaactgtgggcagctcgtttgctttctaggctggctggagaggtgggagctcattgatagactcatgatggaaactatttttgaaacaggcttcctccttcaggagagatcatgcggactaaactgtagcaattccagtgcacctggcagtgatccttttctttgcaaagtactgtctctttggttccagtaagttggaccaccacatgacatcattttccctggaacctggtcactgactaacacagacaattgggactccagagcctcaagagccaggagagggcacagtacatacagagggagtcaaatgggatctcattttgagtcctgccttccgcacactcagaacggcagccccaaggcccggagtgtccaggggcttctggcctgaggtgaatctgccaggcccaagaaggcacaaagaagagtcagggcccaagcttaatgacctgttttttaattcaggaaggtaaatctcgttctctcgtcacacccggaattacaggtccatttgtcctcagtgggagttgatctttgattcccggaactttaagccctgccgtctcgcctggcgccca

SEQ ID NO: 286535 - DNA, 689 bp, Homo sapiens
gccccaactcagcccaccatagacactgaggtgctcgctcttttaatgtcctcgttgtggccgtaagtactttgctaggtttcatttaggcatttggcaaatcagcctggaagtctggacccatgacagcaatcactccctccccacctcctgaagctagaggaaggagagctgtttactaggcacgactgcgaaggcaagggggcaccagctcaggactgcatctgcctgccatttcccttccactcctcctttctggagtctgacattagaaagccagcgagaaggaagattcaaacaaccaaccctgatttcctgcttctccttttcatgagtgttcctgtggtctctgcacctcctttcttgtgtaatgtttaacagcagcaaaattaaaacatgtaagttccatgcggcagtcctcaaggccatgatagcaactgctgctggtggtgcccgatggggaaggggctgccaaactatgcatctgaccaaggactaatatccagaatctacaagaacacaaacaactcaacaagaaaaaacaatcccattaaaaagtgggtaaaggacataaacagacattttccaaaggaagacatacaagtggccaagaaacatatgaaaaatgctcaacatcactaatcaccagataaatgcaaattaaaaccacaatgagatactatcttaca

SEQ ID NO: 286536 - DNA, 5690 bp, Homo sapiens
atgggaatgtattcatacacagcctgagcagctgagcaggtgctggactgcacaaggcaagaggggaagctgggcctcaccagagaattccaagttcaagttccaagtcgcaccagatgatggcgagcctcataagagctgggactgaatataaaaaggtgagaggccaccaccttctccacatgcctggtcctgggcttcttggctcgttttgttttgctctacattaaaaggtcagttgagagaaaatgaggaagtcaaaacaaaggctcctggcgtctggcaggagctgccgaaaggtggctgatgcaatctccccgaggagccacattaatttttaaaaaggcagctgttttcaaagcaaaacgtttaataattttttttggaaccccagtgtaacagaattcaaatgggaaaagtgagagggagtgtttaaacaaaggcatccccaagtcccttcccagttggtcctgaacaatggaggaggtcaaaccttcttttccacagcatgatggtataaatcagggaagtcctggaaatctattccacaccctaaaatacccaaacccattaaaagcacagatataggcttttacaaacatttactaaataagcaaaaccatacaaaatatgttcccgtcggcaatttttcccataccatggactcaaatggttaaaactccttatcatcccagactaatgccaccttttcaattcccaataattccttccgtaacaagcatcattgctccaagaatctctcaactacattcaaacccgagtcttcagacccttggccctctgggacctccagagcctttgacagtgccacccaaggcagcagccagggcttctgctgggacagcccctcactcctccactctgactgtccccactgggcttctctggagcagaagccacgggcagaactgggcagactgcccagtgctgctgagtccagagaagcggcatctgaggggaggcggtggcagtgtggaccccacccttactgtattcacaggccccagctctccatcagccagcctgcccaggtctctgccaaagaagtcgctggtcaatcttcattctcatttttggcatacacctaggtcctttgaatggagctgccctctctctcagcctgttccatgttctttattttccccacttggtccctttctgtaacaaatgcagtgtgtagaatgagacagaccttccagtcagctctgggaaagaggagggagctgttcccccagaggggtcccctcagaaactgatcatcagggctgtgtagccttcaggtcccttcccagggccacgactcattttgctgctgaacaccacctgggactccctgctggggcttccaggaggccatttggtatcatggccccagtaccttgtgcctcacaaagcttgaagctctgtgttcctagtcacttcctggtgaatgctgttgtattagtccattttcatactgctatgaagagatacccagtaatttgaaaagaaaaagaggtttaatggactcatagttccacatggttagggaggcctcacaatcatggtgaaaggcaaaggaagagcaaaagcacatcttacatggcagcaggcaagagaacatgtgcaggggaaatgccctttataaaaccatcagatatcatgagactcactaccatgagtacagtatgggggaaacccacccccatgatccaattacctcccactgggtccctcccacaatgtggggattatgggagctataattcaagatgagatttgggtagggacacagccaaaccatatcagccgaaccttatcccatactggaaaatacacatatgtaaaatacagtgtgcagaccactgtttcagagaccaactggacaaagcccttctgatttaaaacggagtgaaaagaattttttaaaagagtataacaaagtgggcacttttatatacaattagagggactatgattagcaaattttctgtaggccagttaggcagtatttagcaagatcactaaaagatatttctacccttgatccaatgattgcacttataggtagatcacctgagaaaaatcagattccaaacacgattcacacagcgtcttcacttataatggtgaaaagtggaaacaatttgtctagtaatagtgtaatggatgatcccacatgaactattgcacagccattgatcatgtttttgaagaatatttaacagctttgaaaaatgtttactaaatctagtgaaaaaacattacattcaacatcatgattatgtaaaaatacatcagtacaggaagaaaatattggtagaatattaacagtggttttatgtgtatgatgggataaaaggttatcttttttattattatttttaaaatatcttctggccaggcatggtggctcatgcctgtaatcccagcactttgggaggccaaggtgggtggatcatttgaggtcaggagttcaatcaagaccagcctggccaacatggtgaaacccatctctaccaaaaatacaaaaattagccaggcatggtggcgggtgcctgtagtcccagctactcgggaggctgaggcaggagacttgcttgaccccgggaggcagagattgcagtgagccaagatcgcaccactgcactccagcctgggtgacagagtgaggctccatctcaaaacaacaacaaacaaaaacgtctaagttttctataattcatactaccattgtcaggaaaaaatatgtattagtttttaaagtaatgagtatatgatgggatttcatcaccaggtgacatcttgtcttgacccagtaatgagttcccagagcactgcaggtaaaatcagagtgggtgtgtcagtggtccttgacccaggctcaccttcgaatgagcttcagagcttcagaaacacaccagtgcccagcccgaagcacataagttgagctctgattgatctgtggcccagcaatgggtagttcttacagctccccaggtggttgtcttggcagctgtggtgaaaaccaatagcttcctccaccttcaggtctccattaagggtgggccttgcccttcacctcagtcaaaacccaccttcaaaaaagatctgagaaatcccctcactaatgtttccaatggcttgttgtatttggactggagcaaagcctttggctaaagagcacttcactcagtttaagatgtttcacactttcaaagctgcttgggagagacttttcctcctgacctcaaatcagagggcagctaatgacttatttgcaaataggtcctggcaggaggttacctcagacttctggtccttggtggagggcagggtaggagggaaacttgccatgagtttgtaagaaatgccaaagggagaacatgagcttgtctggacacagggaacaagcaagggagagatggactgactgctgtgacttccccgcaggtcccccggcagagggcagtagagatggccggcccaaggcctcggtggcgcgaccagctgctgttcatgagcatcatagtcctcgtgattgtggtcatctgcctgatgttatacgctcttctctgggaggctggcaacctcactgacctgcccaacctgagaatcggcttctataacttctgcctgtggaatgaggacaccagcaccctacagtgtcaccagttccctgagctggaagccctgggggtgcctcgggttggcctgggcctggccaggcttggcgtgtacgggtccctggtcctcaccctctttgccccccagcctctcctcctagcccagtgcaacagtgatgagagagcgtggcggctggcagtgggcttcctggctgtgtcctctgtgctgctggcaggcggcctgggcctcttcctctcctatgtgtggaagtgggtcaggctctccctcccggggcctgggtttctagctctgggcagcgcccaggccttactcatcctcttgcttatagccatggctgtgttccctctgagggctgagagggctgagagcaagcttgagagctgctaaaggcttacgtgattgcaagggttcagttccaaccatggtcagaggtggcacatctgctcagccatctcattttacagctaacgctgatctccagctccagcgatggaacccactacagaggaggtggggcccctgtgtcaaagaggccgaggggcagcaagggcagccagggcacctgtgacttcttagtacaagattgtctgtccttcaggacttccaaggctcccaaagactccctaaaccatgcagctcattgtcacaccaattcctgctttaattaatggatctgagcaaatcttcctctagcttcaggagggtggggagggagtgattgccgtcatggggccagacttccaggctgatttgccaaatgccaaaatgaaacctagcaaagaacttacggcaacaaacgaggacattaaaagagcgagcacctcagtgtctctggggacatggttaaggagcttccactcagcccaccatagtgagtgggccgccataagccatcactggaactccaaccccagaggtccaggagtgatctctgagtgactcaacaaagacaggacacatggggtacaaagacaaggcttgactgcttcaaagcttccctggacctgaagccagacagggcagaggcgtccgctgacaaatcactcccatgatgagaccctggaggactccaaatcctcgctgtgaacaggactggacggttgcgcacaaacaaacgctgccaccctccacttcccaacccagaacttggaaagacattagcacaacttacgcattggggaattgtgtgtattttctagcacttgtgtattggaaaacctgtatggcagtgatttattcatatattcctgtccaaagccacactgaaaacagaggcagagacatgtactctggtgtgatctcttgtcctcagtgtctcttctgggctcctgtccctcttgctttatagctagctgcccggggaccaaggtacaggtgaaagcaaggtagcagcttgcgggaggaggcctgtctggcttaccagtctatacactgtggcctcaacctcccagacagggcagagaactgtgggcagctcgtttgctttctaggctggctggagaggtgggagctcattgatagactcatgatggaaactatttttgaaacaggcttcctccttcaggagagatcatgcggactaaactgtagcaattccagtgcacctggcagtgatccttttctttgcaaagtactgtctctttggttccagtaagttggaccaccacatgacatcattttccctggaacctggtcactgactaacacagacaattgggactccagagcctcaagagccaggagagggcacagtacatacagagggagtcaaatgggatctcattttgagtcctgccttccgcacactcagaacggcagccccaaggcccggagtgtccaggggcttctggcctgaggtgaatctgccaggcccaagaaggcacaaagaagagtcagggcccaagcttaatgacctgttttttaattcaggaaggtaaatctcgttctctcgtcacacccggaattacaggtccatttgtcctcagtgggagttgatctttgattcccggaactttaagccctgccgtctcgcctggcgccca

SEQ ID NO: 286537 - DNA, 727 bp, Homo sapiens
ggctcagcgtggcgctgtcgcagcgcggccagctcggcctccaacgcgcggttctgcgtctccagctgatgcaccttctcgatgaacacggcgaagcggtcgttgaggccctgcagctgctccttctcgttggtgcggatgatcttgtactcgttggtgcgcgccgccgcctggctcaggtccagcccgtcggacgccggcggccggcgataggccaggccgaggccgagcgacgaggccgaggagcaggcggccgaggaggccacattgctgcgggacagcgactgcgagcggaagccgcccgcgccgccggccccagagaggcgggcggacaggcgagagccatccccgaacaccttgcggtaggaggaggaggagcacaggtagtgctccgagccgaagctcatggtgccgggatcggggccggacgtgcggcttcaacgcgagctacagaagaaaggagaggcttgagtgcagtggcaccaatctcggctcactgcaacctccgcctcctgggttccaagtggtcatcccgcctcagcctcccgaagtgctgggattacaggtgtgagccaccacacctggctgcgtaatgttttcaaggttcatccaagttgtagcatgtatcaaaactttatttatttatttctgagacagagtgttgctctgtcacccaggcaggagtgcgtggcatgatctcagctcactgccacctccacctcccaga

SEQ ID NO: 286538 - DNA, 1041 bp, Homo sapiens
gcgcgcgcgacgacctggggcgccgggacagggccatctgcatcggagtcgcccctttccgcagcgcttctccccaagaatcgactgcttcggaagtgactcgagcggaggggtgcctaaacgactgaggtttcccatccggaaaccacacagctctgtcgcatcccttgaccctatcccctcttctttaaccgactgggaggttaggggtttctgggaggtgtcccctacacccaccctcatcctgaggtgaggcgcacagaaagccttcccgagggcgaggtcgtgtttttccagttacagtgaggacctgcagagcgagcccttgtccccttcctcagggtccccaaggagaaaggtgggagatgctacgtcagaaagcatctctccagctgcccctctgcagctcctggggaggctccgggcggaaagatgttcagcaagtgcctctcccagaagagaggggagatcagtaaagaaagtgaccccgagctgcggagagtggggagaagcggcggtacagaggggaaaagaggccagacttggagaagcaggaggcgctgggaattgctggggctcatcgttagggcactaaagcatggcacaggccaggaccacaagctgctggaaagggggctgcagacttttgtgtttagagcattatattttaaaatatttcgaaaggagcatttttaaaccaggagatttcacctgtaaagaaattggatttctggcttcttctgaaaatgggaagagctgggatgcccacagtggcagaggcttgagtgcagtggcaccaatctcggctcactgcaacctccgcctcctgggttccaagtggtcatcccgcctcagcctcccgaagtgctgggattacaggtgtgagccaccacacctggctgcgtaatgttttcaaggttcatccaagttgtagcatgtatcaaaactttatttatttatttctgagacagagtgttgctctgtcacccaggcaggagtgcgtggcatgatctcagctcactgccacctccacctcccaga

SEQ ID NO: 286539 - DNA, 2180 bp, Homo sapiens
gcttccggcacgggatgttttcggttgtttgaccgagagagttgtaggcgcaaagctgaggaaaggagagtgtggagaggggcctggtgtggtggggcccggtgtttgggaccggagggtgttgacggctgatgagttccttgggtttgctctttcttcacctgaaaagaagactccaggaagggcagcacatgccggagaaagatgaattccagcttgaccgcccagaggcgcggcagtgacgccgagttgggaccctgggtgatggctgcgaggtccaaggacgcggcgccgtcccaacgcgacggacttttgcccgtgaaagtggaggaagactcacccggaagttgggagcccaactatcccgcggcttcgccggaccccgaaacttctcgactgcactttaggcagctgcgttaccaggaggtggctggaccggaagaggcgctgagccggctccgagaactctgtcgtcggtggctgagacccgagctgctctccaaggagcagatcctggagctgctggtgctggagcagttcctcaccatcctgcccgaggagcttcaagcctgggtgcgagagcactgcccagagagcggggaggaggcggtggccgtggtgcgggctctgcagcgagcgctcgatggaacctcatcccaggggatggtgactttcgaggacacggctgtgtctctaacctgggaggagtgggagcgcctggacccagcacggagggacttctgcagagagagtgcgcagaaggattccgggagcacagttccgccgagtttggaaagcagagtggagaacaaagagttgattccaatgcaacaaattttagaagaagcggagccacaggggcaactacaagaagcgttccaggggaagcgccccctgttttctaagtgtggcagtacccatgaggacagggtggaaaagcagtccggagaccccttgcccctgaaacttgaaaattctcctgaagcagaaggactcaacagcatctcagatgtcaataagaatggttccatagaaggggaagactctaaaaataatgaattgcagaacagtgccaggtgttccaaccttgttctatgtcagcacatcccgaaagcagagaggcccactgacagtgaggaacacgggaacaagtgcaagcaaagtttccacatggtgacgtggcacgtgctgaaacctcacaagtctgacagtggagacagtttccatcattccagcctttttgagacccagaggcagctccatgaagaaagaccttataaatgtggtaactgtgggaagagtttcaaacaacgctctgacctctttagacaccagagaatccacacaggtgagaaaccctatggctgccaagaatgtgggaaaagcttcagccagagtgctgccctgaccaagcaccagaggacacacacaggcgagaagccgtacacctgtctgaaatgtggggagcgcttcaggcagaattcacacctaaatcgtcatcaaagtacccacagtagagacaaacattttaaatgtgaggaatgcggggaaacctgtcatatttccaacctttttagacatcagagactacataaaggggaaagaccctataagtgtgaagaatgcgagaagagcttcaaacagcgctctgacctctttaaacaccacagaatccacactggggagaagccctatggatgttccgtctgtgggaaacgcttcaatcagagtgcaaccctcattaaacaccagagaattcacactggggaaaagccttacaaatgtcttgaatgtggggaaagatttagacaaagtacacaccttatccgacaccaaagaattcatcaaaataaagtgctgtcggctgggcgtggtggctcacgcctataatcccagcactttgggaggccaaggcaggcagatcatttgagatcaggagtttgaaaccagcctggccaacatggtaaaatcctgtctctactaaaaatacaaaaatgagccgggcatggtggtgcatgcctgtaagcccagctattcgggaggctgaggtaggagaatcacttgaacccaggaggcggaagttgcagtgagctgagatcatgccactgcactccagcctgggcaacagagcgagactccatctcaaaaaagaaataaagtgctgtcattttgatatgttt

SEQ ID NO: 286540 - DNA, 1232 bp, Homo sapiens
gcttccggcacgggatgttttcggttgtttgaccgagagagttgtaggcgcaaagctgaggaaaggagagtgtggagaggggcctggtgtggtggggcccggtgtttgggaccggagggtgttgacggctgatgagttccttgggtttgctctttcttcacctgaaaagaagactccaggaagggcagcacatgccggagaaagatgaattccagcttgaccgcccagaggcgcggcagtgacgccgagttgggaccctgggtgatggctgcgaggtccaaggacgcggcgccgtcccaacgcgacggacttttgcccgtgaaagtggaggaagactcacccggaagttgggagcccaactatcccgcggcttcgccggaccccgaaacttctcgactgcactttaggcagctgcgttaccaggaggtggctggaccggaagaggcgctgagccggctccgagaactctgtcgtcggtggctgagacccgagctgctctccaaggagcagatcctggagctgctggtgctggagcagttcctcaccatcctgcccgaggagcttcaagcctgggtgcgagagcactgcccagagagcggggaggaggcggtggccgtggtgcgggctctgcagcgagcgctcgatggaacctcatcccaggggatggtgactttcgaggacacggctgtgtctctaacctgggaggagtgggagcgcctggacccagcacggagggacttctgcagagagagtgcgcagaaggattccgggagcacagttccgccgagtgacactgtttatggaccgtaagagctgaccgctgtctgaaggcttgcccacagaccttacactcaaaaggattctctaaaaagtgaattctttgatgttgatcaaaccatgccttacgcctaatgacttttccacattcactgcattcataagactttgctcttgtgagaattcgctcatgccccaaaagcaaagatctttgattgaagggtttgccatcctcatcatatctgccctgcttccaccttgtttgcgcattctgatcttgaataaggttaaggttttgaaggaagcccctgctgtattcatcaccactagtagggaaagtaagcctgcaactgtccacaaattctttacacttatgtaacttttctgaaagtttctcagctgattcctgcattaccactgatatcttatatgactctaaatcttcagaaaatttc

SEQ ID NO: 286541 - DNA, 1091 bp, Homo sapiens
tggctcccatagaaaaaccctttgttacatttattgcttttcatggaaacaattacgtgatacacacttgaagtagaggtttataagttctagttctccaatgactgctttccaattaacatcatgtggatatctgtcctttgtgagtgccctggtgcttaataaagcttgtgtgccacttgaaagattttccacatatgacacattggtagggttggcttccagtgtgaatgacctgatgtcgaaaaagattcctcttaaaactaaacgttttcccacattctccacattgaaagaattcctcctttgtatggattctttgatgctgaatgagatccacattcctaccaaaggactgtccacattcactgcatttatgggtgttcggtttactgtgaatctgttgatgacatagaagggttgaatgccggccaaaggcttttccacactcaaggcatttatggcgtttttctccactatggatcacctgatgtcgaataagggttgaattctgactaaacgttttttcacatttgctacatttataaggtttttctttggtgtgaatcctcttatgttcaacaagatacgcgagctgccgaaaacactttccacagtcatgacatctgtatggcttgttttgcaggtgacactgtttatggaccgtaagagctgaccgctgtctgaaggcttgcccacagaccttacactcaaaaggattctctaaaaagtgaattctttgatgttgatcaaaccatgccttacgcctaatgacttttccacattcactgcattcataagactttgctcttgtgagaattcgctcatgccccaaaagcaaagatctttgattgaagggtttgccatcctcatcatatctgccctgcttccaccttgtttgcgcattctgatcttgaataaggttaaggttttgaaggaagcccctgctgtattcatcaccactagtagggaaagtaagcctgcaactgtccacaaattctttacacttatgtaacttttctgaaagtttctcagctgattcctgcattaccactgatatcttatatgactctaaatcttcagaaaatttc

SEQ ID NO: 286542 - DNA, 1975 bp, Homo sapiens
ggtgctctagaggatacccagttccttctctaaatttcaaaataaagctcctgggacaggcgtggtggctcacacctgcaatcccagcactttgggaggccaaggcaggtggatcacctgaggtcaggagtttgagaacagcctggccaacatgagtgagactccatctcaaaataaataaatagcaacagagtaatactctgtctcaaaataaataaatagggaggctgaggcgagcggatcatgaggtcaagagatagagaccatcctggccaacatggtgaaaccccatctctaataaaaatacaaaaattagctgggtgtggtggcgtgcacttgtaatgccagctacttgggaggctgaggtaggataatcagttgaactcgggaggcagaggttgcagtgaactgagatcggaccactgcactccagcctggtgacaaagcaagacaccgtctcaaaaaataaattaattaattaaaaagtaaaaggggtttgagggtttaacattctgccagcacttgcttatttctgtgttgcacagggatgcactggcaggaatttgtattttcacgtttcaggtttggaaagcagagtggagaacaaagagttgattccaatgcaacaaattttagaagaagcggagccacaggggcaactacaagaagcgttccaggggaagcgccccctgttttctaagtgtggcagtacccatgaggacagggtggaaaagcagtccggagaccccttgcccctgaaacttgaaaattctcctgaagcagaaggactcaacagcatctcagatgtcaataagaatggttccatagaaggggaagactctaaaaataatgaattgcagaacagtgccaggtgttccaaccttgttctatgtcagcacatcccgaaagcagagaggcccactgacagtgaggaacacgggaacaagtgcaagcaaagtttccacatggtgacgtggcacgtgctgaaacctcacaagtctgacagtggagacagtttccatcattccagcctttttgagacccagaggcagctccatgaagaaagaccttataaatgtggtaactgtgggaagagtttcaaacaacgctctgacctctttagacaccagagaatccacacaggtgagaaaccctatggctgccaagaatgtgggaaaagcttcagccagagtgctgccctgaccaagcaccagaggacacacacaggcgagaagccgtacacctgtctgaaatgtggggagcgcttcaggcagaattcacacctaaatcgtcatcaaagtacccacagtagagacaaacattttaaatgtgaggaatgcggggaaacctgtcatatttccaacctttttagacatcagagactacataaaggggaaagaccctataagtgtgaagaatgcgagaagagcttcaaacagcgctctgacctctttaaacaccacagaatccacactggggagaagccctatggatgttccgtctgtgggaaacgcttcaatcagagtgcaaccctcattaaacaccagagaattcacactggggaaaagccttacaaatgtcttgaatgtggggaaagatttagacaaagtacacaccttatccgacaccaaagaattcatcaaaataaagtgctgtcggctgggcgtggtggctcacgcctataatcccagcactttgggaggccaaggcaggcagatcatttgagatcaggagtttgaaaccagcctggccaacatggtaaaatcctgtctctactaaaaatacaaaaatgagccgggcatggtggtgcatgcctgtaagcccagctattcgggaggctgaggtaggagaatcacttgaacccaggaggcggaagttgcagtgagctgagatcatgccactgcactccagcctgggcaacagagcgagactccatctcaaaaaagaaataaagtgctgtcattttgatatgttt

SEQ ID NO: 286543 - DNA, 803 bp, Homo sapiens
  misc_feature (69)..(69): n is a, c, g, or t
tcccccgttcacctactattcctaaattctcgcccgcgtcgaccaaatgtgaaaaaacgtttagtcagnattcaacccttattcgacatcaggtgttcggtttactgtgaatctgttgatgacatagaagggttgaatgccggccaaaggcttttccacactcaaggcatttatggcgtttttctccactatggatcacctgatgtcgaataagggttgaattctgactaaacgttttttcacatttgctacatttataaggtttttctttggtgtgaatcctcttatgttcaacaagatacgcgagctgccgaaaacactttccacagtcatgacatctgtatggcttgttttgcaggtgacactgtttatggaccgtaagagctgaccgctgtctgaaggcttgcccacagaccttacactcaaaaggattctctaaaaagtgaattctttgatgttgatcaaaccatgccttacgcctaatgacttttccacattcactgcattcataagactttgctcttgtgagaattcgctcatgccccaaaagcaaagatctttgattgaagggtttgccatcctcatcatatctgccctgcttccaccttgtttgcgcattctgatcttgaataaggttaaggttttgaaggaagcccctgctgtattcatcaccactagtagggaaagtaagcctgcaactgtccacaaattctttacacttatgtaacttttctgaaagtttctcagctgattcctgcattaccactgatatcttatatgactctaaatcttcagaaaatttc

SEQ ID NO: 286544 - DNA, 2053 bp, Homo sapiens
gcttccggcacgggatgttttcggttgtttgaccgagagagttgtaggcgcaaagctgaggaaaggagagtgtggagaggggcctggtgtggtggggcccggtgtttgggaccggagggtgttgacggctgatgagttccttgggtttgctctttcttcacctgaaaagaagactccaggaagggcagcacatgccggagaaagatgaattccagcttgaccgcccagaggcgcggcagtgacgccgagttgggaccctgggtgatggctgcgaggtccaaggacgcggcgccgtcccaacgcgacggacttttgcccgtgaaagtggaggaagactcacccggaagttgggagcccaactatcccgcggcttcgccggaccccgaaacttctcgactgcactttaggcagctgcgttaccaggaggtggctggaccggaagaggcgctgagccggctccgagaactctgtcgtcggtggctgagacccgagctgctctccaaggagcagatcctggagctgctggtgctggagcagttcctcaccatcctgcccgaggagcttcaagcctgggtgcgagagcactgcccagagagcggggaggaggcggtggccgtggtgcgggctctgcagcgagcgctcgatggaacctcatcccaggtttggaaagcagagtggagaacaaagagttgattccaatgcaacaaattttagaagaagcggagccacaggggcaactacaagaagcgttccaggggaagcgccccctgttttctaagtgtggcagtacccatgaggacagggtggaaaagcagtccggagaccccttgcccctgaaacttgaaaattctcctgaagcagaaggactcaacagcatctcagatgtcaataagaatggttccatagaaggggaagactctaaaaataatgaattgcagaacagtgccaggtgttccaaccttgttctatgtcagcacatcccgaaagcagagaggcccactgacagtgaggaacacgggaacaagtgcaagcaaagtttccacatggtgacgtggcacgtgctgaaacctcacaagtctgacagtggagacagtttccatcattccagcctttttgagacccagaggcagctccatgaagaaagaccttataaatgtggtaactgtgggaagagtttcaaacaacgctctgacctctttagacaccagagaatccacacaggtgagaaaccctatggctgccaagaatgtgggaaaagcttcagccagagtgctgccctgaccaagcaccagaggacacacacaggcgagaagccgtacacctgtctgaaatgtggggagcgcttcaggcagaattcacacctaaatcgtcatcaaagtacccacagtagagacaaacattttaaatgtgaggaatgcggggaaacctgtcatatttccaacctttttagacatcagagactacataaaggggaaagaccctataagtgtgaagaatgcgagaagagcttcaaacagcgctctgacctctttaaacaccacagaatccacactggggagaagccctatggatgttccgtctgtgggaaacgcttcaatcagagtgcaaccctcattaaacaccagagaattcacactggggaaaagccttacaaatgtcttgaatgtggggaaagatttagacaaagtacacaccttatccgacaccaaagaattcatcaaaataaagtgctgtcggctgggcgtggtggctcacgcctataatcccagcactttgggaggccaaggcaggcagatcatttgagatcaggagtttgaaaccagcctggccaacatggtaaaatcctgtctctactaaaaatacaaaaatgagccgggcatggtggtgcatgcctgtaagcccagctattcgggaggctgaggtaggagaatcacttgaacccaggaggcggaagttgcagtgagctgagatcatgccactgcactccagcctgggcaacagagcgagactccatctcaaaaaagaaataaagtgctgtcattttgatatgttt

SEQ ID NO: 286545 - DNA, 1027 bp, Homo sapiens
gcttccggcacgggatgttttcggttgtttgaccgagagagttgtaggcgcaaagctgaggaaaggagagtgtggagaggggcctggtgtggtggggcccggtgtttgggaccggagggtgttgacggctgatgagttccttgggtttgctctttcttcacctgaaaagaagactccaggaagggcagcacatgccggagaaagatgaattccagcttgaccgcccagaggcgcggcagtgacgccgagttgggaccctgggtgatggctgcgaggtccaaggacgcggcgccgtcccaacgcgacggacttttgcccgtgaaagtggaggaagactcacccggaagttgggagcccaactatcccgcggcttcgccggaccccgaaacttctcgactgcactttaggcagctgcgttaccaggaggtggctggaccggaagaggcgctgagccggctccgagaactctgtcgtcggtggctgagacccgagctgctctccaaggagcagatcctggagctgctggtgctggagcagttcctcaccatcctgcccgaggagcttcaagcctgggtgcgagagcactgcccagagagcggggaggaggcggtggccgtggtgcgggctctgcagcgagcgctcgatggaacctcatcccaggggatggtgactttcgaggacacggctgtgtctctaacctgggaggagtgggagcgcctggacccagcacggagggacttctgcagagagagtgcgcagaaggattccgggagcacagttccgccgagtgagtgctgttgctctgctggtttattgcggtgtgtggtttgtgaagggctggttcactaccatccctgagccactatgccattcccagacttgggctgagagccttcaggtgccttctgtaacgcaagcaggagcctctgtactgctaggtgctagattcagctttttactttggttcatttttaatgttttatacatacagaaaactatataaaaaaaagataatgaccatcccctg

SEQ ID NO: 286546 - DNA, 2029 bp, Homo sapiens
  misc_feature (5)..(5): n is a, c, g, or t
  misc_feature (43)..(43): n is a, c, g, or t
ccganaagcgcaaccaacccaaaaaaaaaacccaacccccacngaccacactggggagaagccctatggatgttccgtctgtgggaaacgcttcattcagagtgcaaccctcattaaacaccagagaattcacactggggaaaagccttacaaatgtcttgaatgtggggaaagatttagacaaagtacacaccttatccgacaccaaagaattcatcaaaataaagtgctgtcggccgggcatgtggcttacgcctgtaatcccaccactttggaaggcagagccaggagtatcacctgaggtcaggagtttaagaccagcctggccaacatggcgaaaccctgtctctactaaaaatacaaaaattagctgggcatggtggtgcatgtctgtaatcccagctactcgggaggctgaggcaggagaatcacttgaacccaggaagctgaggttgcagtgaactgagatcggaccactgcactccagcctggtgacaaagcaagacaccgtctcaaaaaataaattaattaattaaaaagtaaaaggggtttgagggtttaacattctgccagcacttgcttatttctgtgttgcacagggatgcactggcaggaatttgtattttcacgtttcaggtttggaaagcagagtggagaacaaagagttgattccaatgcaacaaattttagaagaagcggagccacaggggcaactacaagaagcgttccaggggaagcgccccctgttttctaagtgtggcagtacccatgaggacagggtggaaaagcagtccggagaccccttgcccctgaaacttgaaaattctcctgaagcagaaggactcaacagcatctcagatgtcaataagaatggttccatagaaggggaagactctaaaaataatgaattgcagaacagtgccaggtgttccaaccttgttctatgtcagcacatcccgaaagcagagaggcccactgacagtgaggaacacgggaacaagtgcaagcaaagtttccacatggtgacgtggcacgtgctgaaacctcacaagtctgacagtggagacagtttccatcattccagcctttttgagacccagaggcagctccatgaagaaagaccttataaatgtggtaactgtgggaagagtttcaaacaacgctctgacctctttagacaccagagaatccacacaggtgagaaaccctatggctgccaagaatgtgggaaaagcttcagccagagtgctgccctgaccaagcaccagaggacacacacaggcgagaagccgtacacctgtctgaaatgtggggagcgcttcaggcagaattcacacctaaatcgtcatcaaagtacccacagtagagacaaacattttaaatgtgaggaatgcggggaaacctgtcatatttccaacctttttagacatcagagactacataaaggggaaagaccctataagtgtgaagaatgcgagaagagcttcaaacagcgctctgacctctttaaacaccacagaatccacactggggagaagccctatggatgttccgtctgtgggaaacgcttcaatcagagtgcaaccctcattaaacaccagagaattcacactggggaaaagccttacaaatgtcttgaatgtggggaaagatttagacaaagtacacaccttatccgacaccaaagaattcatcaaaataaagtgctgtcggctgggcgtggtggctcacgcctataatcccagcactttgggaggccaaggcaggcagatcatttgagatcaggagtttgaaaccagcctggccaacatggtaaaatcctgtctctactaaaaatacaaaaatgagccgggcatggtggtgcatgcctgtaagcccagctattcgggaggctgaggtaggagaatcacttgaacccaggaggcggaagttgcagtgagctgagatcatgccactgcactccagcctgggcaacagagcgagactccatctcaaaaaagaaataaagtgctgtcattttgatatgttt

SEQ ID NO: 286547 - DNA, 1032 bp, Homo sapiens
  misc_feature (454)..(454): n is a, c, g, or t
tgcggtcagaggccacagaggtgacttacccgagccccacacctggtgtcacagtggagtggagcctggctccttggccctgagttcagcccccatcacagctgccgaattcacagtcagtgctcaacacgtgttcacgtgtttggaggacgaaccaaacccgagttctcggggctccccagccagcatgaagaccgtgtaaccacagcacgcatgggcgggccgcttggcaatggccaggctcatgctctactgagcccctgggggtcacgactcccctgctgctctgtgcagagaaagaaaaggcagtcacctctctcttccctcactggaagacctggtgagcaggaagtacaggatcgttttgaattcagcagattttgaataatgccagatcaggagtggatctctggggtaagatgcaatggtcccacacacttatatgtcaccagangtccactctttggggaacagcaatttgacggaacatgtcaagagcttgtgaaaataagtaattcacattcgacctgttacccagaaaaaaaccggggttcattcacctggtgaatctcaaacggctctccacgagaacgcaggtttggatcagtaggagttttatgactcgccacagtccttggagggactctctggaatttccttatctgacctagaaagtgtcttgccaaaagaaacacatttgccttctgtccgtctgataccccattatccactgcagaaaagaagccggaagaaaagaagtcagaagtccaaccacagctggatggacttttccacaacataatgtctgcctctcagactcattccattcacaagttgatttctgtctccctgatccattcattctccttaataatcatttactgctcctcaaaacaatgctctatgtttcccatctcctcgctcccctgggaaaaagagtacataagcttctgtaccccattgggggattggggtaatcacactgtaattctctcccatgaatgttaataaatgtgtatcctttttctccta

SEQ ID NO: 286548 - DNA, 751 bp, Homo sapiens
  misc_feature (454)..(454): n is a, c, g, or t
tgcggtcagaggccacagaggtgacttacccgagccccacacctggtgtcacagtggagtggagcctggctccttggccctgagttcagcccccatcacagctgccgaattcacagtcagtgctcaacacgtgttcacgtgtttggaggacgaaccaaacccgagttctcggggctccccagccagcatgaagaccgtgtaaccacagcacgcatgggcgggccgcttggcaatggccaggctcatgctctactgagcccctgggggtcacgactcccctgctgctctgtgcagagaaagaaaaggcagtcacctctctcttccctcactggaagacctggtgagcaggaagtacaggatcgttttgaattcagcagattttgaataatgccagatcaggagtggatctctggggtaagatgcaatggtcccacacacttatatgtcaccagangtccactctttggggaacagcaatttgacggaacatgtcaagagcttgtgaaaataagtaattcacattcgacctgttacccagaaaaaaaccggggttcattcacctggtgaatctcaaacggctctccacgagaacgcaggtttggatcagtaggagttttatgactcgccacaggtaagaagagccctgggaggattctccaaagcagtgtctccctgagggaaagtgacaggagggttttatgcagtgatggaggggacgaggggccccgctgctgcagacgcagggcaccat

SEQ ID NO: 286549 - DNA, 6841 bp, Homo sapiens
  misc_feature (3371)..(3371): n is a, c, g, or t
ccgcgcgccatccgccaccctactggacacgggcgagagcgtcgccgccgtagcctccggagaagacaagggcatcgccgcctcagccgccgccgccgccgttttcgcctgcagctgctcaccggatcctcagtcttccacaatgaaccctgtttacagccccgtgcagcctggggctccttatggcaaccctaagaacatggcctacacgggttaccccacagcctatccagcagctgcccctgcctacaatcccagcctgtaccccaccaatagtcccagttatgctccagagtttcagttcctgcattcagcttatgcaactctgctgatgaaacaggcctggccacagaactcgtcttcctgtggcactgaaggcaccttccacctcccagtggacaccgggaccgagaaccgaacttaccaagcatcctctgcggctttcagatatactgcggggacaccatacaaggtcccaccgacccagagtaacactgctccacccccctactccccatcacccaacccctatcagacggccatgtatccaatcagaagtgcctacccccagcagaatctgtatgcccagggagcctactacacacagccggtgtatgctgcccagcctcatgtcatccaccataccacggtcgtccagcccaacagcattccctctgctatctacccagcacctgttgccgccccgaggaccaacggtgtggccatgggcatggtggcaggcaccaccatggcaatgtcagcaggtaccctgctgactacaccccagcacacggcgattggggcacaccctgtctccatgccaacatatagggcccaaggaacccctgcgtacagctacgtgcccccacactggtaaagcctgcagcccatccaaatctggagtcacacattgtatgcaactactcaagtcttacaccggtgctggagcagttccctagcagcaccacctctatttgcaagaagagacaacggaagtgcaagggtcactttatgcatctttaatggttttgatttttatttttggtttttgtaaaagctgctttttctaatctcctgcctctccccaactgtccccctcttagcccctgcccttccagctctatccccttcctcctacctgaccaggccatgtcctctctgctcttccctaagtgtcctgtccctggggatcccagtctagaggcaagcagagagtagggtttattgcagtggttcatctgaaggctggattccatttgaagagcataaacagatgtggtccagggtaggaactcagagctgttgagcaggctacatctctaggggagtgttctggttgttttttcttaagcaagattagttcaggacattcccatgtcccagacacaaatgaaatgtctcctgagaaccattgcaacagaccaagaacaaaaccacctgagtatgtaggcgtgttattagcagcttaataccccaggctgagaacctggggaaaaaagtctttagaatttgggggagggtggggggagggagggcattgtggggaaggagagggaagaagggaggagcggtgcttgcctcatggctttggtttgaaaggtctctggccaaagcatctggccctggaccttctgatttgcacagtgatgttaactgacctggcacttcctcaaaaggtgattttgtccttagacctgccaagcggctgcagggtggtaggatcccagcatcccgaggccttggaaggccggatgccctgtgtcatccagacttcagcctctgagctgtcatggacccactctgatgaggagcttcctcctgattggagtgggaacctagggcatttctctcccttttcttttgcccttcccagtgccaggactcacctgtctgaccatagagcttgcaggcaggccaagctcttggttacctgtgccattcatggcccaagtgaaggaaccacattccaggtgggtgctggcagctctgaaggtgaggatagtgaaggaaaagcaatagcaataaacatttcatagactcatggaactgaagggaccttagcaatcatctcatccatttccctatttggcagatgaggaaactgaggcccagagaagcggaaaggacttccctagaccttacagtaaattagcattaaatgcagccttcctacctagtgggcaccttgcttacaaaaatttacctagggacggattggcttggttttgtaaaaattaagtcggcagcgcccatacctggtgagtctggaatggtctctgggctcctgtttctgctcttttcctccacggactccaaaggcgggggttgaagactgggcagaggctacatgggggcggatggcaggaacagaaattgcaaatgaagaaatagcatttggaaattctgtgaagacatctggaacttccgtcctgtacctgactccacctccaggagaaggagcaggtggactggccgaaaaggagaggccatgcttttaggacagtagcccctcatcccgagaggagaggaagaggaggaagacagtgggagtcatcaggagaggagaatgaggatgaggcccaggagacaggctcatctgggagaagagggacccctgggacgaggaggtccctgctagtctcagccaggagcctggattgcccagcagcagcctccggcacccagcgcttggctgggccagcagcccctctgggggtggggcacgaacattttattgtaaaaaatgggatcattgacaacatttgggactttaaaaaactgctttcatttaaaattcatgcaaacttggacatatccttaccccaacctcccatgtctccctaagggagggaaaaatcaggaaacccttgggttggaaggagctcagaagctgtctagccattcccaggagggtaaagcccatcagcctccttggcctagagccaggagtttgggggcccaccttcctgggcttccaaggaactttaggaccagtaagaaaaaattcagctgttctaaattatctgttctgggtgctgatgaggtttcactttaaaacaatagaaagttttccagtgttaattcactttttgcaaatacctccttccaccctctttggttttgtaaaggtgggtgaaggttgttctagattatgtcatacgtgtttgaaaaatgccaaaataataataatgataataataatagaaacctttggatttgtcaggtgcatcacagaggtcaaagcacttcacggcctttcatgtactcgccctgagagggacagggttagagttattacagtcaattgacaaatgaggaaacaggttatggaagggaacaggcccacagtgagcagcatgctggtatccgcnaggcttcccagaaccctgctgcctccatgtgggctggggtggaaccacagagaggagaaaggaagaagaggagacctaggaatgaccttgtaacttttgttctttcaacaccagtaagtaaaactaacagctggacctcacagttcacagaacagttgaacataaattatctggtttaacccgatgaaatagaggttatttctcctatttgatccataaggaaatcaaggcttggaaaagtcaagtgacttgctaataagtgacagagccactcgaatcccaggctgtctgctgtctcgttcccctccatctgatccccacacaggctcacgtactgaagcatctgtgctctgtgccctatcttagcacctactatgtaattcaagagcaaaggggggccccaaggtgaaaataaggcactgaaaggctgtggtctggaagagcccaggtccagcacccctttttcagtatgagccccagttcagccggcctcagcctcttgctgtgatggagatccacaagcctagccaagcttggggagtcactgcaaaaggactgagcccaggagagcggggacagtcatgtgcctctggtaggatgggcacagttactggtaaggtcacagagatctagtgggaggtaccataggtagatacctccaaagattctagatggcacggtggtcaagctagacaaaaagtcagagctggaagggccgtctcattgaaggcaggcaagcaagagaggacaagggatgtagccgcctgacagtgagctacagcactggccccaggatgcaaacccctctctcctcctcatgccactgcctctccccaagtgcaacacctatggccaggatcaggggtacagatggctcgttaccagccaacccttttgaattcttctacttctacctgaccccctctcctcactggcctggggtcaagaagtttgagtctgggagctggattgcctgcaaatagtgaaagcctgaaacataatggtttgccatgttttgaaaaaaaatgcatatttaatttcttcctcatgagataggacagttgctgttctttcttacctggcaatgaccctaaaatgtatatcctctttcctgaatatttagcagagacacacacacctgtccagagcgtttttggtatgcaaagtactttgacattggttgccaaagtcctccattttatagatgaaaaaactaaggctcaggaggcttgagacttgctaaaaggtcacacagcttggaagtgattcttcaaatcctctgctctttctgctgccacctgctgggtctcttggcaagcatggagggaggggctaactgtactttatagagctgggaagcccagtctctgagctgagcagatttgtatgaactgctttgggccaggacctgtaatgagccctggggagggacccagaggcacatctaactggcagcacaaggaggatgagaatttgcaactaaaggcctcacttggacaaaacactttggggtcacaatgcccaggaccgaagacatgttcaaggacagcacgaggcatctttctattgggagacccatgtccttggtaagcctgcacacctggcttcctaatccctgagagcctgcccactgtccagatccagtgagttggtacaaaacgtacagactgaagtccctgggcttgcttttcccatgggtgaggaccagaaccagactctgagcatccttacccctggccacccgaattgttccaagtttgaggtaccccgttcccagagatctgggggtccttctttggagggcttgctttgttctgatggccttcagaaaggaatcacatgaagtataaaaggacaggccccttggtcaccaagttttggctcctcatacagataggactcatccaggttcccagcgaggcactgactaagcgaggctcagagcttccatatcaaattcctcagctttgttctgtgcccagagggggtgggccccattctgggccctgtgaactttgtcttatatatcaccatctgtatcagaattcctcctcaattgcagttaagtgaaaatacgtggaagtctgcttttccatcctgtattctcccacatcactactggctgtgcggcccccgctgcttgccaagcttgggaatccagagaggggcagtagtagagtgggccagttgggacccacccgcagagctgaagaaacacgccagactaactgatgggattccacaccggagcctctgagcgcacaggcaggcatgccaagggggctgcagggtttgtcctttacttatctgcccctttcctagaaaactcctcgtttctgaaattaggcattatatggttccaggacccagccttcaaaattcctggcaggccagcttcaacattccatggccagccctgcctaagccagacttgggtcccagtccctcagtctctccagtggatatcttctgtggtgcatgctgttgagtccaacccaaaggccaaccgaggcacacaggagttgggactggctgccacaaagctagaaagggacaaaacagcacttgcttccctatggccacatggatagtccctggatatccttgctgtggtagaggtcctctacccattccagccactgatagcagggggattttccttcctaaggagaacagatgtaacagctttgcaaagtaccggcccataggaatcaaatgggtgagatcagctttgggcctgaccccagcaagaccagcatctccagaccccagcctttctcctcaggcctaagagagtcagggaaagagaggagactgtcccagagaccttctcctcgggtcagccagatagtctggatctatggtgtgactcaagctcctccttacccagggggggtaaggccaggcctctagctacttggagttgtctgtaataatcttgaaaggcccaagggcctgtccccatcctgacttaaaggcatctgcttccctgtttcatatcacatgacagagaaacctgttctcatggcatgtaacatccctgtgaagagagcgttgtatatgattttgtattttttaattcattttaatctacaggttggaatctaatttttaaattttattggaactcacattttaaaaagaaataaaatttaaaataataataataataataataataataataaacctttgaccagtgtcttccaagtagtttgatcaaagaatttataggtgttttcaaaacacagtccggagtgtaaagattggaaagccccatggccttgcctgtgtgtatgaagtgtaaatctggttttgttttgttgttttggattcttttgggtttttgttttgttttgaagatcagacagtgatcactctgaaagattgaagccaagaatttgtaactatggtatttactgtaagctgtagaacactcaataactattaaaaaaaaaaattccccccca

SEQ ID NO: 286550 - DNA, 584 bp, Homo sapiens
  misc_feature (8)..(8): n is a, c, g, or t
gcgccctnacgtcaacccagtcaaccatctcagaaaggctgaccatcccatgtgtctgaacaggccccttgggttgggtgtttctgtccagcacaaggcccttgctttgtgtctgtgattggtggtggccacttcttatttctgtctaatgccattcttgtgtcttcccttaagcaactctgctgatgaaacaggcctggccacagaactcgtcttcctgtggcactgaaggcaccttccacctcccagtggacaccgggaccgagaaccgaacttaccaagcatcctctgcggctttcagtaaatacagcctgtctcatttccttgttccccttggttgggactgatttgtttcttaggaagaaaggaaagggagctttttaaaatgacatttatgagataaataatgttttaagaggttcttttacccaggcagaaaattacccctccttattcaggaaaggtcattctctttgatcatgcactcagctttggggaaacacaaaccactgagggaaggagaaggaaatactcacctggccaacaatttgattgggttgacgtcaggggtaccgagactcaat

SEQ ID NO: 286551 - DNA, 5793 bp, Homo sapiens
  misc_feature (2584)..(2584): n is a, c, g, or t
aggcgggaggcaggcagcttcactaggaaggcacagcgggctcccgagttgaggggagaagcctcctgaatatcactgacactgtttctttcccctttccctctgcagatctggagtcacacattgtatgcaactactcaagtcttacaccggtgctggagcagttccctagcagcaccacctctatttgcaagaagagacaacggaagtgcaagggtcactttatgcatctttaatggttttgatttttatttttggtttttgtaaaagctgctttttctaatctcctgcctctccccaactgtccccctcttagcccctgcccttccagctctatccccttcctcctacctgaccaggccatgtcctctctgctcttccctaagtgtcctgtccctggggatcccagtctagaggcaagcagagagtagggtttattgcagtggttcatctgaaggctggattccatttgaagagcataaacagatgtggtccagggtaggaactcagagctgttgagcaggctacatctctaggggagtgttctggttgttttttcttaagcaagattagttcaggacattcccatgtcccagacacaaatgaaatgtctcctgagaaccattgcaacagaccaagaacaaaaccacctgagtatgtaggcgtgttattagcagcttaataccccaggctgagaacctggggaaaaaagtctttagaatttgggggagggtggggggagggagggcattgtggggaaggagagggaagaagggaggagcggtgcttgcctcatggctttggtttgaaaggtctctggccaaagcatctggccctggaccttctgatttgcacagtgatgttaactgacctggcacttcctcaaaaggtgattttgtccttagacctgccaagcggctgcagggtggtaggatcccagcatcccgaggccttggaaggccggatgccctgtgtcatccagacttcagcctctgagctgtcatggacccactctgatgaggagcttcctcctgattggagtgggaacctagggcatttctctcccttttcttttgcccttcccagtgccaggactcacctgtctgaccatagagcttgcaggcaggccaagctcttggttacctgtgccattcatggcccaagtgaaggaaccacattccaggtgggtgctggcagctctgaaggtgaggatagtgaaggaaaagcaatagcaataaacatttcatagactcatggaactgaagggaccttagcaatcatctcatccatttccctatttggcagatgaggaaactgaggcccagagaagcggaaaggacttccctagaccttacagtaaattagcattaaatgcagccttcctacctagtgggcaccttgcttacaaaaatttacctagggacggattggcttggttttgtaaaaattaagtcggcagcgcccatacctggtgagtctggaatggtctctgggctcctgtttctgctcttttcctccacggactccaaaggcgggggttgaagactgggcagaggctacatgggggcggatggcaggaacagaaattgcaaatgaagaaatagcatttggaaattctgtgaagacatctggaacttccgtcctgtacctgactccacctccaggagaaggagcaggtggactggccgaaaaggagaggccatgcttttaggacagtagcccctcatcccgagaggagaggaagaggaggaagacagtgggagtcatcaggagaggagaatgaggatgaggcccaggagacaggctcatctgggagaagagggacccctgggacgaggaggtccctgctagtctcagccaggagcctggattgcccagcagcagcctccggcacccagcgcttggctgggccagcagcccctctgggggtggggcacgaacattttattgtaaaaaatgggatcattgacaacatttgggactttaaaaaactgctttcatttaaaattcatgcaaacttggacatatccttaccccaacctcccatgtctccctaagggagggaaaaatcaggaaacccttgggttggaaggagctcagaagctgtctagccattcccaggagggtaaagcccatcagcctccttggcctagagccaggagtttgggggcccaccttcctgggcttccaaggaactttaggaccagtaagaaaaaattcagctgttctaaattatctgttctgggtgctgatgaggtttcactttaaaacaatagaaagttttccagtgttaattcactttttgcaaatacctccttccaccctctttggttttgtaaaggtgggtgaaggttgttctagattatgtcatacgtgtttgaaaaatgccaaaataataataatgataataataatagaaacctttggatttgtcaggtgcatcacagaggtcaaagcacttcacggcctttcatgtactcgccctgagagggacagggttagagttattacagtcaattgacaaatgaggaaacaggttatggaagggaacaggcccacagtgagcagcatgctggtatccgcnaggcttcccagaaccctgctgcctccatgtgggctggggtggaaccacagagaggagaaaggaagaagaggagacctaggaatgaccttgtaacttttgttctttcaacaccagtaagtaaaactaacagctggacctcacagttcacagaacagttgaacataaattatctggtttaacccgatgaaatagaggttatttctcctatttgatccataaggaaatcaaggcttggaaaagtcaagtgacttgctaataagtgacagagccactcgaatcccaggctgtctgctgtctcgttcccctccatctgatccccacacaggctcacgtactgaagcatctgtgctctgtgccctatcttagcacctactatgtaattcaagagcaaaggggggccccaaggtgaaaataaggcactgaaaggctgtggtctggaagagcccaggtccagcacccctttttcagtatgagccccagttcagccggcctcagcctcttgctgtgatggagatccacaagcctagccaagcttggggagtcactgcaaaaggactgagcccaggagagcggggacagtcatgtgcctctggtaggatgggcacagttactggtaaggtcacagagatctagtgggaggtaccataggtagatacctccaaagattctagatggcacggtggtcaagctagacaaaaagtcagagctggaagggccgtctcattgaaggcaggcaagcaagagaggacaagggatgtagccgcctgacagtgagctacagcactggccccaggatgcaaacccctctctcctcctcatgccactgcctctccccaagtgcaacacctatggccaggatcaggggtacagatggctcgttaccagccaacccttttgaattcttctacttctacctgaccccctctcctcactggcctggggtcaagaagtttgagtctgggagctggattgcctgcaaatagtgaaagcctgaaacataatggtttgccatgttttgaaaaaaaatgcatatttaatttcttcctcatgagataggacagttgctgttctttcttacctggcaatgaccctaaaatgtatatcctctttcctgaatatttagcagagacacacacacctgtccagagcgtttttggtatgcaaagtactttgacattggttgccaaagtcctccattttatagatgaaaaaactaaggctcaggaggcttgagacttgctaaaaggtcacacagcttggaagtgattcttcaaatcctctgctctttctgctgccacctgctgggtctcttggcaagcatggagggaggggctaactgtactttatagagctgggaagcccagtctctgagctgagcagatttgtatgaactgctttgggccaggacctgtaatgagccctggggagggacccagaggcacatctaactggcagcacaaggaggatgagaatttgcaactaaaggcctcacttggacaaaacactttggggtcacaatgcccaggaccgaagacatgttcaaggacagcacgaggcatctttctattgggagacccatgtccttggtaagcctgcacacctggcttcctaatccctgagagcctgcccactgtccagatccagtgagttggtacaaaacgtacagactgaagtccctgggcttgcttttcccatgggtgaggaccagaaccagactctgagcatccttacccctggccacccgaattgttccaagtttgaggtaccccgttcccagagatctgggggtccttctttggagggcttgctttgttctgatggccttcagaaaggaatcacatgaagtataaaaggacaggccccttggtcaccaagttttggctcctcatacagataggactcatccaggttcccagcgaggcactgactaagcgaggctcagagcttccatatcaaattcctcagctttgttctgtgcccagagggggtgggccccattctgggccctgtgaactttgtcttatatatcaccatctgtatcagaattcctcctcaattgcagttaagtgaaaatacgtggaagtctgcttttccatcctgtattctcccacatcactactggctgtgcggcccccgctgcttgccaagcttgggaatccagagaggggcagtagtagagtgggccagttgggacccacccgcagagctgaagaaacacgccagactaactgatgggattccacaccggagcctctgagcgcacaggcaggcatgccaagggggctgcagggtttgtcctttacttatctgcccctttcctagaaaactcctcgtttctgaaattaggcattatatggttccaggacccagccttcaaaattcctggcaggccagcttcaacattccatggccagccctgcctaagccagacttgggtcccagtccctcagtctctccagtggatatcttctgtggtgcatgctgttgagtccaacccaaaggccaaccgaggcacacaggagttgggactggctgccacaaagctagaaagggacaaaacagcacttgcttccctatggccacatggatagtccctggatatccttgctgtggtagaggtcctctacccattccagccactgatagcagggggattttccttcctaaggagaacagatgtaacagctttgcaaagtaccggcccataggaatcaaatgggtgagatcagctttgggcctgaccccagcaagaccagcatctccagaccccagcctttctcctcaggcctaagagagtcagggaaagagaggagactgtcccagagaccttctcctcgggtcagccagatagtctggatctatggtgtgactcaagctcctccttacccagggggggtaaggccaggcctctagctacttggagttgtctgtaataatcttgaaaggcccaagggcctgtccccatcctgacttaaaggcatctgcttccctgtttcatatcacatgacagagaaacctgttctcatggcatgtaacatccctgtgaagagagcgttgtatatgattttgtattttttaattcattttaatctacaggttggaatctaatttttaaattttattggaactcacattttaaaaagaaataaaatttaaaataataataataataataataataataataaacctttgaccagtgtcttcca

SEQ ID NO: 286552 - DNA, 5129 bp, Homo sapiens
  misc_feature (1920)..(1920): n is a, c, g, or t
ccgcgcgccatccgccaccctactggacacgggcgagagcgtcgccgccgtagcctccggagaagacaagggcatcgccgcctcagccgccgccgccgccgttttcgcctgcagctgctcaccggatcctcagtcttccacaatgaaccctgtttacagccccgtgcagcctggggctccttatggcaaccctaagaacatggcctacacgggttaccccacagcctatccagcagctgcccctgcctacaatcccagcctgtaccccaccaatagtcccagttatgctccagagtttcagttcctgcattcagcttatgcaactctgctgatgaaacaggcctggccacagaactcgtcttcctgtggcactgaaggcaccttccacctcccagtggacaccgggaccgagaaccgaacttaccaagcatcctctgcggctttcagatatactgcggggacaccatacaaggtcccaccgacccagagtaacactgctccacccccctactccccatcacccaacccctatcagacggccatgtatccaatcagaagtgcctacccccagcagaatctgtatgcccagggagcctactacacacagccggtgtatgctgcccagcctcatgtcatccaccataccacggtcgtccagcccaacagcattccctctgctatctacccagcacctgttgccgccccgaggaccaacggtgtggccatgggcatggtggcaggcaccaccatggcaatgtcagcaggtaccctgctgactacaccccagcacacggcgattggggcacaccctgtctccatgccaacatatagggcccaaggaacccctgcgtacagctacgtgcccttccagctctatccccttcctcctacgctacatgggggcggatggcaggaacagaaattgcaaatgaagaaatagcatttggaaattctgtgaagacatctggaacttccgtcctgtacctgactccacctccaggagaaggagcaggtggactggccgaaaaggagaggccatgcttttaggacagtagcccctcatcccgagaggagaggaagaggaggaagacagtgggagtcatcaggagaggagaatgaggatgaggcccaggagacaggctcatctgggagaagagggacccctgggacgaggaggtccctgctagtctcagccaggagcctggattgcccagcagcagcctccggcacccagcgcttggctgggccagcagcccctctgggggtggggcacgaacattttattgtaaaaaatgggatcattgacaacatttgggactttaaaaaactgctttcatttaaaattcatgcaaacttggacatatccttaccccaacctcccatgtctccctaagggagggaaaaatcaggaaacccttgggttggaaggagctcagaagctgtctagccattcccaggagggtaaagcccatcagcctccttggcctagagccaggagtttgggggcccaccttcctgggcttccaaggaactttaggaccagtaagaaaaaattcagctgttctaaattatctgttctgggtgctgatgaggtttcactttaaaacaatagaaagttttccagtgttaattcactttttgcaaatacctccttccaccctctttggttttgtaaaggtgggtgaaggttgttctagattatgtcatacgtgtttgaaaaatgccaaaataataataatgataataataatagaaacctttggatttgtcaggtgcatcacagaggtcaaagcacttcacggcctttcatgtactcgccctgagagggacagggttagagttattacagtcaattgacaaatgaggaaacaggttatggaagggaacaggcccacagtgagcagcatgctggtatccgcnaggcttcccagaaccctgctgcctccatgtgggctggggtggaaccacagagaggagaaaggaagaagaggagacctaggaatgaccttgtaacttttgttctttcaacaccagtaagtaaaactaacagctggacctcacagttcacagaacagttgaacataaattatctggtttaacccgatgaaatagaggttatttctcctatttgatccataaggaaatcaaggcttggaaaagtcaagtgacttgctaataagtgacagagccactcgaatcccaggctgtctgctgtctcgttcccctccatctgatccccacacaggctcacgtactgaagcatctgtgctctgtgccctatcttagcacctactatgtaattcaagagcaaaggggggccccaaggtgaaaataaggcactgaaaggctgtggtctggaagagcccaggtccagcacccctttttcagtatgagccccagttcagccggcctcagcctcttgctgtgatggagatccacaagcctagccaagcttggggagtcactgcaaaaggactgagcccaggagagcggggacagtcatgtgcctctggtaggatgggcacagttactggtaaggtcacagagatctagtgggaggtaccataggtagatacctccaaagattctagatggcacggtggtcaagctagacaaaaagtcagagctggaagggccgtctcattgaaggcaggcaagcaagagaggacaagggatgtagccgcctgacagtgagctacagcactggccccaggatgcaaacccctctctcctcctcatgccactgcctctccccaagtgcaacacctatggccaggatcaggggtacagatggctcgttaccagccaacccttttgaattcttctacttctacctgaccccctctcctcactggcctggggtcaagaagtttgagtctgggagctggattgcctgcaaatagtgaaagcctgaaacataatggtttgccatgttttgaaaaaaaatgcatatttaatttcttcctcatgagataggacagttgctgttctttcttacctggcaatgaccctaaaatgtatatcctctttcctgaatatttagcagagacacacacacctgtccagagcgtttttggtatgcaaagtactttgacattggttgccaaagtcctccattttatagatgaaaaaactaaggctcaggaggcttgagacttgctaaaaggtcacacagcttggaagtgattcttcaaatcctctgctctttctgctgccacctgctgggtctcttggcaagcatggagggaggggctaactgtactttatagagctgggaagcccagtctctgagctgagcagatttgtatgaactgctttgggccaggacctgtaatgagccctggggagggacccagaggcacatctaactggcagcacaaggaggatgagaatttgcaactaaaggcctcacttggacaaaacactttggggtcacaatgcccaggaccgaagacatgttcaaggacagcacgaggcatctttctattgggagacccatgtccttggtaagcctgcacacctggcttcctaatccctgagagcctgcccactgtccagatccagtgagttggtacaaaacgtacagactgaagtccctgggcttgcttttcccatgggtgaggaccagaaccagactctgagcatccttacccctggccacccgaattgttccaagtttgaggtaccccgttcccagagatctgggggtccttctttggagggcttgctttgttctgatggccttcagaaaggaatcacatgaagtataaaaggacaggccccttggtcaccaagttttggctcctcatacagataggactcatccaggttcccagcgaggcactgactaagcgaggctcagagcttccatatcaaattcctcagctttgttctgtgcccagagggggtgggccccattctgggccctgtgaactttgtcttatatatcaccatctgtatcagaattcctcctcaattgcagttaagtgaaaatacgtggaagtctgcttttccatcctgtattctcccacatcactactggctgtgcggcccccgctgcttgccaagcttgggaatccagagaggggcagtagtagagtgggccagttgggacccacccgcagagctgaagaaacacgccagactaactgatgggattccacaccggagcctctgagcgcacaggcaggcatgccaagggggctgcagggtttgtcctttacttatctgcccctttcctagaaaactcctcgtttctgaaattaggcattatatggttccaggacccagccttcaaaattcctggcaggccagcttcaacattccatggccagccctgcctaagccagacttgggtcccagtccctcagtctctccagtggatatcttctgtggtgcatgctgttgagtccaacccaaaggccaaccgaggcacacaggagttgggactggctgccacaaagctagaaagggacaaaacagcacttgcttccctatggccacatggatagtccctggatatccttgctgtggtagaggtcctctacccattccagccactgatagcagggggattttccttcctaaggagaacagatgtaacagctttgcaaagtaccggcccataggaatcaaatgggtgagatcagctttgggcctgaccccagcaagaccagcatctccagaccccagcctttctcctcaggcctaagagagtcagggaaagagaggagactgtcccagagaccttctcctcgggtcagccagatagtctggatctatggtgtgactcaagctcctccttacccagggggggtaaggccaggcctctagctacttggagttgtctgtaataatcttgaaaggcccaagggcctgtccccatcctgacttaaaggcatctgcttccctgtttcatatcacatgacagagaaacctgttctcatggcatgtaacatccctgtgaagagagcgttgtatatgattttgtattttttaattcattttaatctacaggttggaatctaatttttaaattttattggaactcacattttaaaaagaaataaaatttaaaataataataataataataataataataataaacctttgaccagtgtcttcca

SEQ ID NO: 286553 - DNA, 4549 bp, Homo sapiens
  misc_feature (1340)..(1340): n is a, c, g, or t
gctcggtacccccattccattcccgcttagcaatcatctcatccatttccctatttggcagatgaggaaactgaggcccagagaagcggaaaggacttccctagaccttacagtaaattagcattaaatgcagccttcctacctagtgggcaccttgcttacaaaaatttacctagggacggattggcttggttttgtaaaaattaagtcggcagcgcccatacctggtgagtctggaatggtctctgggctcctgtttctgctcttttcctccacggactccaaaggcgggggttgaagactgggcagaggctacatgggggcggatggcaggaacagaaattgcaaatgaagaaatagcatttggaaattctgtgaagacatctggaacttccgtcctgtacctgactccacctccaggagaaggagcaggtggactggccgaaaaggagaggccatgcttttaggacagtagcccctcatcccgagaggagaggaagaggaggaagacagtgggagtcatcaggagaggagaatgaggatgaggcccaggagacaggctcatctgggagaagagggacccctgggacgaggaggtccctgctagtctcagccaggagcctggattgcccagcagcagcctccggcacccagcgcttggctgggccagcagcccctctgggggtggggcacgaacattttattgtaaaaaatgggatcattgacaacatttgggactttaaaaaactgctttcatttaaaattcatgcaaacttggacatatccttaccccaacctcccatgtctccctaagggagggaaaaatcaggaaacccttgggttggaaggagctcagaagctgtctagccattcccaggagggtaaagcccatcagcctccttggcctagagccaggagtttgggggcccaccttcctgggcttccaaggaactttaggaccagtaagaaaaaattcagctgttctaaattatctgttctgggtgctgatgaggtttcactttaaaacaatagaaagttttccagtgttaattcactttttgcaaatacctccttccaccctctttggttttgtaaaggtgggtgaaggttgttctagattatgtcatacgtgtttgaaaaatgccaaaataataataatgataataataatagaaacctttggatttgtcaggtgcatcacagaggtcaaagcacttcacggcctttcatgtactcgccctgagagggacagggttagagttattacagtcaattgacaaatgaggaaacaggttatggaagggaacaggcccacagtgagcagcatgctggtatccgcnaggcttcccagaaccctgctgcctccatgtgggctggggtggaaccacagagaggagaaaggaagaagaggagacctaggaatgaccttgtaacttttgttctttcaacaccagtaagtaaaactaacagctggacctcacagttcacagaacagttgaacataaattatctggtttaacccgatgaaatagaggttatttctcctatttgatccataaggaaatcaaggcttggaaaagtcaagtgacttgctaataagtgacagagccactcgaatcccaggctgtctgctgtctcgttcccctccatctgatccccacacaggctcacgtactgaagcatctgtgctctgtgccctatcttagcacctactatgtaattcaagagcaaaggggggccccaaggtgaaaataaggcactgaaaggctgtggtctggaagagcccaggtccagcacccctttttcagtatgagccccagttcagccggcctcagcctcttgctgtgatggagatccacaagcctagccaagcttggggagtcactgcaaaaggactgagcccaggagagcggggacagtcatgtgcctctggtaggatgggcacagttactggtaaggtcacagagatctagtgggaggtaccataggtagatacctccaaagattctagatggcacggtggtcaagctagacaaaaagtcagagctggaagggccgtctcattgaaggcaggcaagcaagagaggacaagggatgtagccgcctgacagtgagctacagcactggccccaggatgcaaacccctctctcctcctcatgccactgcctctccccaagtgcaacacctatggccaggatcaggggtacagatggctcgttaccagccaacccttttgaattcttctacttctacctgaccccctctcctcactggcctggggtcaagaagtttgagtctgggagctggattgcctgcaaatagtgaaagcctgaaacataatggtttgccatgttttgaaaaaaaatgcatatttaatttcttcctcatgagataggacagttgctgttctttcttacctggcaatgaccctaaaatgtatatcctctttcctgaatatttagcagagacacacacacctgtccagagcgtttttggtatgcaaagtactttgacattggttgccaaagtcctccattttatagatgaaaaaactaaggctcaggaggcttgagacttgctaaaaggtcacacagcttggaagtgattcttcaaatcctctgctctttctgctgccacctgctgggtctcttggcaagcatggagggaggggctaactgtactttatagagctgggaagcccagtctctgagctgagcagatttgtatgaactgctttgggccaggacctgtaatgagccctggggagggacccagaggcacatctaactggcagcacaaggaggatgagaatttgcaactaaaggcctcacttggacaaaacactttggggtcacaatgcccaggaccgaagacatgttcaaggacagcacgaggcatctttctattgggagacccatgtccttggtaagcctgcacacctggcttcctaatccctgagagcctgcccactgtccagatccagtgagttggtacaaaacgtacagactgaagtccctgggcttgcttttcccatgggtgaggaccagaaccagactctgagcatccttacccctggccacccgaattgttccaagtttgaggtaccccgttcccagagatctgggggtccttctttggagggcttgctttgttctgatggccttcagaaaggaatcacatgaagtataaaaggacaggccccttggtcaccaagttttggctcctcatacagataggactcatccaggttcccagcgaggcactgactaagcgaggctcagagcttccatatcaaattcctcagctttgttctgtgcccagagggggtgggccccattctgggccctgtgaactttgtcttatatatcaccatctgtatcagaattcctcctcaattgcagttaagtgaaaatacgtggaagtctgcttttccatcctgtattctcccacatcactactggctgtgcggcccccgctgcttgccaagcttgggaatccagagaggggcagtagtagagtgggccagttgggacccacccgcagagctgaagaaacacgccagactaactgatgggattccacaccggagcctctgagcgcacaggcaggcatgccaagggggctgcagggtttgtcctttacttatctgcccctttcctagaaaactcctcgtttctgaaattaggcattatatggttccaggacccagccttcaaaattcctggcaggccagcttcaacattccatggccagccctgcctaagccagacttgggtcccagtccctcagtctctccagtggatatcttctgtggtgcatgctgttgagtccaacccaaaggccaaccgaggcacacaggagttgggactggctgccacaaagctagaaagggacaaaacagcacttgcttccctatggccacatggatagtccctggatatccttgctgtggtagaggtcctctacccattccagccactgatagcagggggattttccttcctaaggagaacagatgtaacagctttgcaaagtaccggcccataggaatcaaatgggtgagatcagctttgggcctgaccccagcaagaccagcatctccagaccccagcctttctcctcaggcctaagagagtcagggaaagagaggagactgtcccagagaccttctcctcgggtcagccagatagtctggatctatggtgtgactcaagctcctccttacccagggggggtaaggccaggcctctagctacttggagttgtctgtaataatcttgaaaggcccaagggcctgtccccatcctgacttaaaggcatctgcttccctgtttcatatcacatgacagagaaacctgttctcatggcatgtaacatccctgtgaagagagcgttgtatatgattttgtattttttaattcattttaatctacaggttggaatctaatttttaaattttattggaactcacattttaaaaagaaataaaatttaaaataataataataataataataataataataaacctttgaccagtgtcttcca

SEQ ID NO: 286554 - DNA, 6000 bp, Homo sapiens
  misc_feature (2584)..(2584): n is a, c, g, or t
aggcgggaggcaggcagcttcactaggaaggcacagcgggctcccgagttgaggggagaagcctcctgaatatcactgacactgtttctttcccctttccctctgcagatctggagtcacacattgtatgcaactactcaagtcttacaccggtgctggagcagttccctagcagcaccacctctatttgcaagaagagacaacggaagtgcaagggtcactttatgcatctttaatggttttgatttttatttttggtttttgtaaaagctgctttttctaatctcctgcctctccccaactgtccccctcttagcccctgcccttccagctctatccccttcctcctacctgaccaggccatgtcctctctgctcttccctaagtgtcctgtccctggggatcccagtctagaggcaagcagagagtagggtttattgcagtggttcatctgaaggctggattccatttgaagagcataaacagatgtggtccagggtaggaactcagagctgttgagcaggctacatctctaggggagtgttctggttgttttttcttaagcaagattagttcaggacattcccatgtcccagacacaaatgaaatgtctcctgagaaccattgcaacagaccaagaacaaaaccacctgagtatgtaggcgtgttattagcagcttaataccccaggctgagaacctggggaaaaaagtctttagaatttgggggagggtggggggagggagggcattgtggggaaggagagggaagaagggaggagcggtgcttgcctcatggctttggtttgaaaggtctctggccaaagcatctggccctggaccttctgatttgcacagtgatgttaactgacctggcacttcctcaaaaggtgattttgtccttagacctgccaagcggctgcagggtggtaggatcccagcatcccgaggccttggaaggccggatgccctgtgtcatccagacttcagcctctgagctgtcatggacccactctgatgaggagcttcctcctgattggagtgggaacctagggcatttctctcccttttcttttgcccttcccagtgccaggactcacctgtctgaccatagagcttgcaggcaggccaagctcttggttacctgtgccattcatggcccaagtgaaggaaccacattccaggtgggtgctggcagctctgaaggtgaggatagtgaaggaaaagcaatagcaataaacatttcatagactcatggaactgaagggaccttagcaatcatctcatccatttccctatttggcagatgaggaaactgaggcccagagaagcggaaaggacttccctagaccttacagtaaattagcattaaatgcagccttcctacctagtgggcaccttgcttacaaaaatttacctagggacggattggcttggttttgtaaaaattaagtcggcagcgcccatacctggtgagtctggaatggtctctgggctcctgtttctgctcttttcctccacggactccaaaggcgggggttgaagactgggcagaggctacatgggggcggatggcaggaacagaaattgcaaatgaagaaatagcatttggaaattctgtgaagacatctggaacttccgtcctgtacctgactccacctccaggagaaggagcaggtggactggccgaaaaggagaggccatgcttttaggacagtagcccctcatcccgagaggagaggaagaggaggaagacagtgggagtcatcaggagaggagaatgaggatgaggcccaggagacaggctcatctgggagaagagggacccctgggacgaggaggtccctgctagtctcagccaggagcctggattgcccagcagcagcctccggcacccagcgcttggctgggccagcagcccctctgggggtggggcacgaacattttattgtaaaaaatgggatcattgacaacatttgggactttaaaaaactgctttcatttaaaattcatgcaaacttggacatatccttaccccaacctcccatgtctccctaagggagggaaaaatcaggaaacccttgggttggaaggagctcagaagctgtctagccattcccaggagggtaaagcccatcagcctccttggcctagagccaggagtttgggggcccaccttcctgggcttccaaggaactttaggaccagtaagaaaaaattcagctgttctaaattatctgttctgggtgctgatgaggtttcactttaaaacaatagaaagttttccagtgttaattcactttttgcaaatacctccttccaccctctttggttttgtaaaggtgggtgaaggttgttctagattatgtcatacgtgtttgaaaaatgccaaaataataataatgataataataatagaaacctttggatttgtcaggtgcatcacagaggtcaaagcacttcacggcctttcatgtactcgccctgagagggacagggttagagttattacagtcaattgacaaatgaggaaacaggttatggaagggaacaggcccacagtgagcagcatgctggtatccgcnaggcttcccagaaccctgctgcctccatgtgggctggggtggaaccacagagaggagaaaggaagaagaggagacctaggaatgaccttgtaacttttgttctttcaacaccagtaagtaaaactaacagctggacctcacagttcacagaacagttgaacataaattatctggtttaacccgatgaaatagaggttatttctcctatttgatccataaggaaatcaaggcttggaaaagtcaagtgacttgctaataagtgacagagccactcgaatcccaggctgtctgctgtctcgttcccctccatctgatccccacacaggctcacgtactgaagcatctgtgctctgtgccctatcttagcacctactatgtaattcaagagcaaaggggggccccaaggtgaaaataaggcactgaaaggctgtggtctggaagagcccaggtccagcacccctttttcagtatgagccccagttcagccggcctcagcctcttgctgtgatggagatccacaagcctagccaagcttggggagtcactgcaaaaggactgagcccaggagagcggggacagtcatgtgcctctggtaggatgggcacagttactggtaaggtcacagagatctagtgggaggtaccataggtagatacctccaaagattctagatggcacggtggtcaagctagacaaaaagtcagagctggaagggccgtctcattgaaggcaggcaagcaagagaggacaagggatgtagccgcctgacagtgagctacagcactggccccaggatgcaaacccctctctcctcctcatgccactgcctctccccaagtgcaacacctatggccaggatcaggggtacagatggctcgttaccagccaacccttttgaattcttctacttctacctgaccccctctcctcactggcctggggtcaagaagtttgagtctgggagctggattgcctgcaaatagtgaaagcctgaaacataatggtttgccatgttttgaaaaaaaatgcatatttaatttcttcctcatgagataggacagttgctgttctttcttacctggcaatgaccctaaaatgtatatcctctttcctgaatatttagcagagacacacacacctgtccagagcgtttttggtatgcaaagtactttgacattggttgccaaagtcctccattttatagatgaaaaaactaaggctcaggaggcttgagacttgctaaaaggtcacacagcttggaagtgattcttcaaatcctctgctctttctgctgccacctgctgggtctcttggcaagcatggagggaggggctaactgtactttatagagctgggaagcccagtctctgagctgagcagatttgtatgaactgctttgggccaggacctgtaatgagccctggggagggacccagaggcacatctaactggcagcacaaggaggatgagaatttgcaactaaaggcctcacttggacaaaacactttggggtcacaatgcccaggaccgaagacatgttcaaggacagcacgaggcatctttctattgggagacccatgtccttggtaagcctgcacacctggcttcctaatccctgagagcctgcccactgtccagatccagtgagttggtacaaaacgtacagactgaagtccctgggcttgcttttcccatgggtgaggaccagaaccagactctgagcatccttacccctggccacccgaattgttccaagtttgaggtaccccgttcccagagatctgggggtccttctttggagggcttgctttgttctgatggccttcagaaaggaatcacatgaagtataaaaggacaggccccttggtcaccaagttttggctcctcatacagataggactcatccaggttcccagcgaggcactgactaagcgaggctcagagcttccatatcaaattcctcagctttgttctgtgcccagagggggtgggccccattctgggccctgtgaactttgtcttatatatcaccatctgtatcagaattcctcctcaattgcagttaagtgaaaatacgtggaagtctgcttttccatcctgtattctcccacatcactactggctgtgcggcccccgctgcttgccaagcttgggaatccagagaggggcagtagtagagtgggccagttgggacccacccgcagagctgaagaaacacgccagactaactgatgggattccacaccggagcctctgagcgcacaggcaggcatgccaagggggctgcagggtttgtcctttacttatctgcccctttcctagaaaactcctcgtttctgaaattaggcattatatggttccaggacccagccttcaaaattcctggcaggccagcttcaacattccatggccagccctgcctaagccagacttgggtcccagtccctcagtctctccagtggatatcttctgtggtgcatgctgttgagtccaacccaaaggccaaccgaggcacacaggagttgggactggctgccacaaagctagaaagggacgtggtagaggtcctctacccattccagccactgatagcagggggattttccttcctaaggagaacagatgtaacagctttgcaaagtaccggcccataggaatcaaatgggtgagatcagctttgggcctgaccccagcaagaccagcatctccagaccccagcctttctcctcaggcctaagagagtcagggaaagagaggagactgtcccagagaccttctcctcgggtcagccagatagtctggatctatggtgtgactcaagctcctccttacccagggggggtaaggccaggcctctagctacttggagttgtctgtaataatcttgaaaggcccaagggcctgtccccatcctgacttaaaggcatctgcttccctgtttcatatcacatgacagagaaacctgttctcatggcatgtaacatccctgtgaagagagcgttgtatatgattttgtattttttaattcattttaatctacaggttggaatctaatttttaaattttattggaactcacattttaaaaagaaataaaatttaaaataataataataataataataataataataaacctttgaccagtgtcttccaagtagtttgatcaaagaatttataggtgttttcaaaacacagtccggagtgtaaagattggaaagccccatggccttgcctgtgtgtatgaagtgtaaatctggttttgttttgttgttttggattcttttgggtttttgttttgttttgaagatcagacagtgatcactctgaaagattgaagccaagaatttgtaactatggtatttactgtaagctgtagaacactcaataactattaaaaaaaaaaattccccccca

SEQ ID NO: 286555 - DNA, 6372 bp, Homo sapiens
  misc_feature (2584)..(2584): n is a, c, g, or t
aggcgggaggcaggcagcttcactaggaaggcacagcgggctcccgagttgaggggagaagcctcctgaatatcactgacactgtttctttcccctttccctctgcagatctggagtcacacattgtatgcaactactcaagtcttacaccggtgctggagcagttccctagcagcaccacctctatttgcaagaagagacaacggaagtgcaagggtcactttatgcatctttaatggttttgatttttatttttggtttttgtaaaagctgctttttctaatctcctgcctctccccaactgtccccctcttagcccctgcccttccagctctatccccttcctcctacctgaccaggccatgtcctctctgctcttccctaagtgtcctgtccctggggatcccagtctagaggcaagcagagagtagggtttattgcagtggttcatctgaaggctggattccatttgaagagcataaacagatgtggtccagggtaggaactcagagctgttgagcaggctacatctctaggggagtgttctggttgttttttcttaagcaagattagttcaggacattcccatgtcccagacacaaatgaaatgtctcctgagaaccattgcaacagaccaagaacaaaaccacctgagtatgtaggcgtgttattagcagcttaataccccaggctgagaacctggggaaaaaagtctttagaatttgggggagggtggggggagggagggcattgtggggaaggagagggaagaagggaggagcggtgcttgcctcatggctttggtttgaaaggtctctggccaaagcatctggccctggaccttctgatttgcacagtgatgttaactgacctggcacttcctcaaaaggtgattttgtccttagacctgccaagcggctgcagggtggtaggatcccagcatcccgaggccttggaaggccggatgccctgtgtcatccagacttcagcctctgagctgtcatggacccactctgatgaggagcttcctcctgattggagtgggaacctagggcatttctctcccttttcttttgcccttcccagtgccaggactcacctgtctgaccatagagcttgcaggcaggccaagctcttggttacctgtgccattcatggcccaagtgaaggaaccacattccaggtgggtgctggcagctctgaaggtgaggatagtgaaggaaaagcaatagcaataaacatttcatagactcatggaactgaagggaccttagcaatcatctcatccatttccctatttggcagatgaggaaactgaggcccagagaagcggaaaggacttccctagaccttacagtaaattagcattaaatgcagccttcctacctagtgggcaccttgcttacaaaaatttacctagggacggattggcttggttttgtaaaaattaagtcggcagcgcccatacctggtgagtctggaatggtctctgggctcctgtttctgctcttttcctccacggactccaaaggcgggggttgaagactgggcagaggctacatgggggcggatggcaggaacagaaattgcaaatgaagaaatagcatttggaaattctgtgaagacatctggaacttccgtcctgtacctgactccacctccaggagaaggagcaggtggactggccgaaaaggagaggccatgcttttaggacagtagcccctcatcccgagaggagaggaagaggaggaagacagtgggagtcatcaggagaggagaatgaggatgaggcccaggagacaggctcatctgggagaagagggacccctgggacgaggaggtccctgctagtctcagccaggagcctggattgcccagcagcagcctccggcacccagcgcttggctgggccagcagcccctctgggggtggggcacgaacattttattgtaaaaaatgggatcattgacaacatttgggactttaaaaaactgctttcatttaaaattcatgcaaacttggacatatccttaccccaacctcccatgtctccctaagggagggaaaaatcaggaaacccttgggttggaaggagctcagaagctgtctagccattcccaggagggtaaagcccatcagcctccttggcctagagccaggagtttgggggcccaccttcctgggcttccaaggaactttaggaccagtaagaaaaaattcagctgttctaaattatctgttctgggtgctgatgaggtttcactttaaaacaatagaaagttttccagtgttaattcactttttgcaaatacctccttccaccctctttggttttgtaaaggtgggtgaaggttgttctagattatgtcatacgtgtttgaaaaatgccaaaataataataatgataataataatagaaacctttggatttgtcaggtgcatcacagaggtcaaagcacttcacggcctttcatgtactcgccctgagagggacagggttagagttattacagtcaattgacaaatgaggaaacaggttatggaagggaacaggcccacagtgagcagcatgctggtatccgcnaggcttcccagaaccctgctgcctccatgtgggctggggtggaaccacagagaggagaaaggaagaagaggagacctaggaatgaccttgtaacttttgttctttcaacaccagtaagtaaaactaacagctggacctcacagttcacagaacagttgaacataaattatctggtttaacccgatgaaatagaggttatttctcctatttgatccataaggaaatcaaggcttggaaaagtcaagtgacttgctaataagtgacagagccactcgaatcccaggctgtctgctgtctcgttcccctccatctgatccccacacaggctcacgtactgaagcatctgtgctctgtgccctatcttagcacctactatgtaattcaagagcaaaggggggccccaaggtgaaaataaggcactgaaaggctgtggtctggaagagcccaggtccagcacccctttttcagtatgagccccagttcagccggcctcagcctcttgctgtgatggagatccacaagcctagccaagcttggggagtcactgcaaaaggactgagcccaggagagcggggacagtcatgtgcctctggtaggatgggcacagttactggtaaggtcacagagatctagtgggaggtaccataggtagatacctccaaagattctagatggcacggtggtcaagctagacaaaaagtcagagctggaagggccgtctcattgaaggcaggcaagcaagagaggacaagggatgtagccgcctgacagtgagctacagcactggccccaggatgcaaacccctctctcctcctcatgccactgcctctccccaagtgcaacacctatggccaggatcaggggtacagatggctcgttaccagccaacccttttgaattcttctacttctacctgaccccctctcctcactggcctggggtcaagaagtttgagtctgggagctggattgcctgcaaatagtgaaagcctgaaacataatggtttgccatgttttgaaaaaaaatgcatatttaatttcttcctcatgagataggacagttgctgttctttcttacctggcaatgaccctaaaatgtatatcctctttcctgaatatttagcagagacacacacacctgtccagagcgtttttggtatgcaaagtactttgacattggttgccaaagtcctccattttatagatgaaaaaactaaggctcaggaggcttgagacttgctaaaaggtcacacagcttggaagtgattcttcaaatcctctgctctttctgctgccacctgctgggtctcttggcaagcatggagggaggggctaactgtactttatagagctgggaagcccagtctctgagctgagcagatttgtatgaactgctttgggccaggacctgtaatgagccctggggagggacccagaggcacatctaactggcagcacaaggaggatgagaatttgcaactaaaggcctcacttggacaaaacactttggggtcacaatgcccaggaccgaagacatgttcaaggacagcacgaggcatctttctattgggagacccatgtccttggtaagcctgcacacctggcttcctaatccctgagagcctgcccactgtccagatccagtgagttggtacaaaacgtacagactgaagtccctgggcttgcttttcccatgggtgaggaccagaaccagactctgagcatccttacccctggccacccgaattgttccaagtttgaggtaccccgttcccagagatctgggggtccttctttggagggcttgctttgttctgatggccttcagaaaggaatcacatgaagtataaaaggacaggccccttggtcaccaagttttggctcctcatacagataggactcatccaggttcccagcgaggcactgactaagcgaggctcagagcttccatatcaaattcctcagctttgttctgtgcccagagggggtgggccccattctgggccctgtgaactttgtcttatatatcaccatctgtatcagaattcctcctcaattgcagttaagtgaaaatacgtggaagtctgcttttccatcctgtattctcccacatcactactggctgtgcggcccccgctgcttgccaagcttgggaatccagagaggggcagtagtagagtgggccagttgggacccacccgcagagctgaagaaacacgccagactaactgatgggattccacaccggagcctctgagcgcacaggcaggcatgccaagggggctgcagggtttgtcctttacttatctgcccctttcctagaaaactcctcgtttctgaaattaggcattatatggttccaggacccagccttcaaaattcctggcaggccagcttcaacattccatggccagccctgcctaagccagacttgggtcccagtccctcagtctctccagtggatatcttctgtggtgcatgctgttgagtccaacccaaaggccaaccgaggcacacaggagttgggactggctgccacaaagctagaaagggacaaaacagcacttgcttccctatggccacatggatagtccctggatatccttgctgtggtagaggtcctctacccattccagccactgatagcagggggattttccttcctaaggagaacagatgtaacagctttgcaaagtaccggcccataggaatcaaatgggtgagatcagctttgggcctgaccccagcaagaccagcatctccagaccccagcctttctcctcaggcctaagagagtcagggaaagagaggagactgtcccagagaccttctcctcgggtcagccagatagtctggatctatggtgtgactcaagctcctccttacccagggggggtaaggccaggcctctagctacttggagttgtctgtaataatcttgaaaggcccaagggcctgtccccatcctgacttaaaggcatctgcttccctgtttcatatcacatgacagagaaacctgttctcatggcatgtaacatccctgtgaagagagcgttgtatatgattttgtattttttaattcattttaatctacaggttggaatctaatttttaaattttattggaactcacattttaaaaagaaataaaatttaaaataataataataataataataataataataaacctttgaccagtgtcttccaagtagtttgatcaaagaatttataggtgttttcaaaacacagtccggagtgtaaagattggaaagccccatggccttgcctgtgtgtatgaagtgtaaatctggttttgttttgttgttttggattcttttgggtttttgttttgttttgaagatcagacagtgatcactctgaaagattgaagccaagaatttgtaactatggtatttactgtaagctgtagaacactcaataactattaaaaaaaaaaattcccccccaaaaaaaagtcttaggtgactagactgagtggttcttggggagggaggcacagaggactgtcctgggccagtgagtcccttgggcgtctccccaagttgatgctaaatttgttctcagtagtcaagaaaaacctatggtacatcttacagctgatctgacaggggtctgccctaagggtctcacagctgctggggagctttaagtggcaacttcagcacccaccctaagtgtgtgatgtgggagcacagtgaggccattcagagttgaaatccattgagccatccgcgcaataaagctgacatctattgtgtgaaaaaa

SEQ ID NO: 286556 - DNA, 5770 bp, Homo sapiens
  misc_feature (2584)..(2584): n is a, c, g, or t
aggcgggaggcaggcagcttcactaggaaggcacagcgggctcccgagttgaggggagaagcctcctgaatatcactgacactgtttctttcccctttccctctgcagatctggagtcacacattgtatgcaactactcaagtcttacaccggtgctggagcagttccctagcagcaccacctctatttgcaagaagagacaacggaagtgcaagggtcactttatgcatctttaatggttttgatttttatttttggtttttgtaaaagctgctttttctaatctcctgcctctccccaactgtccccctcttagcccctgcccttccagctctatccccttcctcctacctgaccaggccatgtcctctctgctcttccctaagtgtcctgtccctggggatcccagtctagaggcaagcagagagtagggtttattgcagtggttcatctgaaggctggattccatttgaagagcataaacagatgtggtccagggtaggaactcagagctgttgagcaggctacatctctaggggagtgttctggttgttttttcttaagcaagattagttcaggacattcccatgtcccagacacaaatgaaatgtctcctgagaaccattgcaacagaccaagaacaaaaccacctgagtatgtaggcgtgttattagcagcttaataccccaggctgagaacctggggaaaaaagtctttagaatttgggggagggtggggggagggagggcattgtggggaaggagagggaagaagggaggagcggtgcttgcctcatggctttggtttgaaaggtctctggccaaagcatctggccctggaccttctgatttgcacagtgatgttaactgacctggcacttcctcaaaaggtgattttgtccttagacctgccaagcggctgcagggtggtaggatcccagcatcccgaggccttggaaggccggatgccctgtgtcatccagacttcagcctctgagctgtcatggacccactctgatgaggagcttcctcctgattggagtgggaacctagggcatttctctcccttttcttttgcccttcccagtgccaggactcacctgtctgaccatagagcttgcaggcaggccaagctcttggttacctgtgccattcatggcccaagtgaaggaaccacattccaggtgggtgctggcagctctgaaggtgaggatagtgaaggaaaagcaatagcaataaacatttcatagactcatggaactgaagggaccttagcaatcatctcatccatttccctatttggcagatgaggaaactgaggcccagagaagcggaaaggacttccctagaccttacagtaaattagcattaaatgcagccttcctacctagtgggcaccttgcttacaaaaatttacctagggacggattggcttggttttgtaaaaattaagtcggcagcgcccatacctggtgagtctggaatggtctctgggctcctgtttctgctcttttcctccacggactccaaaggcgggggttgaagactgggcagaggctacatgggggcggatggcaggaacagaaattgcaaatgaagaaatagcatttggaaattctgtgaagacatctggaacttccgtcctgtacctgactccacctccaggagaaggagcaggtggactggccgaaaaggagaggccatgcttttaggacagtagcccctcatcccgagaggagaggaagaggaggaagacagtgggagtcatcaggagaggagaatgaggatgaggcccaggagacaggctcatctgggagaagagggacccctgggacgaggaggtccctgctagtctcagccaggagcctggattgcccagcagcagcctccggcacccagcgcttggctgggccagcagcccctctgggggtggggcacgaacattttattgtaaaaaatgggatcattgacaacatttgggactttaaaaaactgctttcatttaaaattcatgcaaacttggacatatccttaccccaacctcccatgtctccctaagggagggaaaaatcaggaaacccttgggttggaaggagctcagaagctgtctagccattcccaggagggtaaagcccatcagcctccttggcctagagccaggagtttgggggcccaccttcctgggcttccaaggaactttaggaccagtaagaaaaaattcagctgttctaaattatctgttctgggtgctgatgaggtttcactttaaaacaatagaaagttttccagtgttaattcactttttgcaaatacctccttccaccctctttggttttgtaaaggtgggtgaaggttgttctagattatgtcatacgtgtttgaaaaatgccaaaataataataatgataataataatagaaacctttggatttgtcaggtgcatcacagaggtcaaagcacttcacggcctttcatgtactcgccctgagagggacagggttagagttattacagtcaattgacaaatgaggaaacaggttatggaagggaacaggcccacagtgagcagcatgctggtatccgcnaggcttcccagaaccctgctgcctccatgtgggctggggtggaaccacagagaggagaaaggaagaagaggagacctaggaatgaccttgtaacttttgttctttcaacaccagtaagtaaaactaacagctggacctcacagttcacagaacagttgaacataaattatctggtttaacccgatgaaatagaggttatttctcctatttgatccataaggaaatcaaggcttggaaaagtcaagtgacttgctaataagtgacagagccactcgaatcccaggctgtctgctgtctcgttcccctccatctgatccccacacaggctcacgtactgaagcatctgtgctctgtgccctatcttagcacctactatgtaattcaagagcaaaggggggccccaaggtgaaaataaggcactgaaaggctgtggtctggaagagcccaggtccagcacccctttttcagtatgagccccagttcagccggcctcagcctcttgctgtgatggagatccacaagcctagccaagcttggggagtcactgcaaaaggactgagcccaggagagcggggacagtcatgtgcctctggtaggatgggcacagttactggtaaggtcacagagatctagtgggaggtaccataggtagatacctccaaagattctagatggcacggtggtcaagctagacaaaaagtcagagctggaagggccgtctcattgaaggcaggcaagcaagagaggacaagggatgtagccgcctgacagtgagctacagcactggccccaggatgcaaacccctctctcctcctcatgccactgcctctccccaagtgcaacacctatggccaggatcaggggtacagatggctcgttaccagccaacccttttgaattcttctacttctacctgaccccctctcctcactggcctggggtcaagaagtttgagtctgggagctggattgcctgcaaatagtgaaagcctgaaacataatggtttgccatgttttgaaaaaaaatgcatatttaatttcttcctcatgagataggacagttgctgttctttcttacctggcaatgaccctaaaatgtatatcctctttcctgaatatttagcagagacacacacacctgtccagagcgtttttggtatgcaaagtactttgacattggttgccaaagtcctccattttatagatgaaaaaactaaggctcaggaggcttgagacttgctaaaaggtcacacagcttggaagtgattcttcaaatcctctgctctttctgctgccacctgctgggtctcttggcaagcatggagggaggggctaactgtactttatagagctgggaagcccagtctctgagctgagcagatttgtatgaactgctttgggccaggacctgtaatgagccctggggagggacccagaggcacatctaactggcagcacaaggaggatgagaatttgcaactaaaggcctcacttggacaaaacactttggggtcacaatgcccaggaccgaagacatgttcaaggacagcacgaggcatctttctattgggagacccatgtccttggtaagcctgcacacctggcttcctaatccctgagagcctgcccactgtccagatccagtgagttggtacaaaacgtacagactgaagtccctgggcttgcttttcccatgggtgaggaccagaaccagactctgagcatccttacccctggccacccgaattgttccaagtttgaggtaccccgttcccagagatctgggggtccttctttggagggcttgctttgttctgatggccttcagaaaggaatcacatgaagtataaaaggacaggccccttggtcaccaagttttggctcctcatacagataggactcatccaggttcccagcgaggcactgactaagcgaggctcagagcttccatatcaaattcctcagctttgttctgtgcccagagggggtgggccccattctgggccctgtgaactttgtttatctgcccctttcctagaaaactcctcgtttctgaaattaggcattatatggttccaggacccagccttcaaaattcctggcaggccagcttcaacattccatggccagccctgcctaagccagacttgggtcccagtccctcagtctctccagtggatatcttctgtggtgcatgctgttgagtccaacccaaaggccaaccgaggcacacaggagttgggactggctgccacaaagctagaaagggacaaaacagcacttgcttccctatggccacatggatagtccctggatatccttgctgtggtagaggtcctctacccattccagccactgatagcagggggattttccttcctaaggagaacagatgtaacagctttgcaaagtaccggcccataggaatcaaatgggtgagatcagctttgggcctgaccccagcaagaccagcatctccagaccccagcctttctcctcaggcctaagagagtcagggaaagagaggagactgtcccagagaccttctcctcgggtcagccagatagtctggatctatggtgtgactcaagctcctccttacccagggggggtaaggccaggcctctagctacttggagttgtctgtaataatcttgaaaggcccaagggcctgtccccatcctgacttaaaggcatctgcttccctgtttcatatcacatgacagagaaacctgttctcatggcatgtaacatccctgtgaagagagcgttgtatatgattttgtattttttaattcattttaatctacaggttggaatctaatttttaaattttattggaactcacattttaaaaagaaataaaatttaaaataataataataataataataataataataaacctttgaccagtgtcttccaagtagtttgatcaaagaatttataggtgttttcaaaacacagtccggagtgtaaagattggaaagccccatggccttgcctgtgtgtatgaagtgtaaatctggttttgttttgttgttttggattcttttgggtttttgttttgttttgaagatcagacagtgatcactctgaaagattgaagccaagaatttgtaactatggtatttactgtaagctgtagaacactcaataactattaaaaaaaaaaattccccccca

SEQ ID NO: 286557 - DNA, 2894 bp, Homo sapiens
  misc_feature (15)..(15): n is a, c, g, or t
  misc_feature (23)..(23): n is a, c, g, or t
attgttgatcccccncggggtantggatatgtcgaccaggcgcctcggatgatctagtgggaggtaccataggtagatacctccaaagattctagatggcacggtggtcaagctagacaaaaagtcagagctggaagggccgtctcattgaaggcaggcaagcaagagaggacaagggatgtagccgcctgacagtgagctacagcactggccccaggatgcaaacccctctctcctcctcatgccactgcctctccccaagtgcaacacctatggccaggatcaggggtacagatggctcgttaccagccaacccttttgaattcttctacttctacctgaccccctctcctcactggcctggggtcaagaagtttgagtctgggagctggattgcctgcaaatagtgaaagcctgaaacataatggtttgccatgttttgaaaaaaaatgcatatttaatttcttcctcatgagataggacagttgctgttctttcttacctggcaatgaccctaaaatgtatatcctctttcctgaatatttagcagagacacacacacctgtccagagcgtttttggtatgcaaagtactttgacattggttgccaaagtcctccattttatagatgaaaaaactaaggctcaggaggcttgagacttgctaaaaggtcacacagcttggaagtgattcttcaaatcctctgctctttctgctgccacctgctgggtctcttggcaagcatggagggaggggctaactgtactttatagagctgggaagcccagtctctgagctgagcagatttgtatgaactgctttgggccaggacctgtaatgagccctggggagggacccagaggcacatctaactggcagcacaaggaggatgagaatttgcaactaaaggcctcacttggacaaaacactttggggtcacaatgcccaggaccgaagacatgttcaaggacagcacgaggcatctttctattgggagacccatgtccttggtaagcctgcacacctggcttcctaatccctgagagcctgcccactgtccagatccagtgagttggtacaaaacgtacagactgaagtccctgggcttgcttttcccatgggtgaggaccagaaccagactctgagcatccttacccctggccacccgaattgttccaagtttgaggtaccccgttcccagagatctgggggtccttctttggagggcttgctttgttctgatggccttcagaaaggaatcacatgaagtataaaaggacaggccccttggtcaccaagttttggctcctcatacagataggactcatccaggttcccagcgaggcactgactaagcgaggctcagagcttccatatcaaattcctcagctttgttctgtgcccagagggggtgggccccattctgggccctgtgaactttgtcttatatatcaccatctgtatcagaattcctcctcaattgcagttaagtgaaaatacgtggaagtctgcttttccatcctgtattctcccacatcactactggctgtgcggcccccgctgcttgccaagcttgggaatccagagaggggcagtagtagagtgggccagttgggacccacccgcagagctgaagaaacacgccagactaactgatgggattccacaccggagcctctgagcgcacaggcaggcatgccaagggggctgcagggtttgtcctttacttatctgcccctttcctagaaaactcctcgtttctgaaattaggcattatatggttccaggacccagccttcaaaattcctggcaggccagcttcaacattccatggccagccctgcctaagccagacttgggtcccagtccctcagtctctccagtggatatcttctgtggtgcatgctgttgagtccaacccaaaggccaaccgaggcacacaggagttgggactggctgccacaaagctagaaagggacaaaacagcacttgcttccctatggccacatggatagtccctggatatccttgctgtggtagaggtcctctacccattccagccactgatagcagggggattttccttcctaaggagaacagatgtaacagctttgcaaagtaccggcccataggaatcaaatgggtgagatcagctttgggcctgaccccagcaagaccagcatctccagaccccagcctttctcctcaggcctaagagagtcagggaaagagaggagactgtcccagagaccttctcctcgggtcagccagatagtctggatctatggtgtgactcaagctcctccttacccagggggggtaaggccaggcctctagctacttggagttgtctgtaataatcttgaaaggcccaagggcctgtccccatcctgacttaaaggcatctgcttccctgtttcatatcacatgacagagaaacctgttctcatggcatgtaacatccctgtgaagagagcgttgtatatgattttgtattttttaattcattttaatctacaggttggaatctaatttttaaattttattggaactcacattttaaaaagaaataaaatttaaaataataataataataataataataataataaacctttgaccagtgtcttccaagtagtttgatcaaagaatttataggtgttttcaaaacacagtccggagtgtaaagattggaaagccccatggccttgcctgtgtgtatgaagtgtaaatctggttttgttttgttgttttggattcttttgggtttttgttttgttttgaagatcagacagtgatcactctgaaagattgaagccaagaatttgtaactatggtatttactgtaagctgtagaacactcaataactattaaaaaaaaaaattccccccca

SEQ ID NO: 286558 - DNA, 5775 bp, Homo sapiens
  misc_feature (2584)..(2584): n is a, c, g, or t
aggcgggaggcaggcagcttcactaggaaggcacagcgggctcccgagttgaggggagaagcctcctgaatatcactgacactgtttctttcccctttccctctgcagatctggagtcacacattgtatgcaactactcaagtcttacaccggtgctggagcagttccctagcagcaccacctctatttgcaagaagagacaacggaagtgcaagggtcactttatgcatctttaatggttttgatttttatttttggtttttgtaaaagctgctttttctaatctcctgcctctccccaactgtccccctcttagcccctgcccttccagctctatccccttcctcctacctgaccaggccatgtcctctctgctcttccctaagtgtcctgtccctggggatcccagtctagaggcaagcagagagtagggtttattgcagtggttcatctgaaggctggattccatttgaagagcataaacagatgtggtccagggtaggaactcagagctgttgagcaggctacatctctaggggagtgttctggttgttttttcttaagcaagattagttcaggacattcccatgtcccagacacaaatgaaatgtctcctgagaaccattgcaacagaccaagaacaaaaccacctgagtatgtaggcgtgttattagcagcttaataccccaggctgagaacctggggaaaaaagtctttagaatttgggggagggtggggggagggagggcattgtggggaaggagagggaagaagggaggagcggtgcttgcctcatggctttggtttgaaaggtctctggccaaagcatctggccctggaccttctgatttgcacagtgatgttaactgacctggcacttcctcaaaaggtgattttgtccttagacctgccaagcggctgcagggtggtaggatcccagcatcccgaggccttggaaggccggatgccctgtgtcatccagacttcagcctctgagctgtcatggacccactctgatgaggagcttcctcctgattggagtgggaacctagggcatttctctcccttttcttttgcccttcccagtgccaggactcacctgtctgaccatagagcttgcaggcaggccaagctcttggttacctgtgccattcatggcccaagtgaaggaaccacattccaggtgggtgctggcagctctgaaggtgaggatagtgaaggaaaagcaatagcaataaacatttcatagactcatggaactgaagggaccttagcaatcatctcatccatttccctatttggcagatgaggaaactgaggcccagagaagcggaaaggacttccctagaccttacagtaaattagcattaaatgcagccttcctacctagtgggcaccttgcttacaaaaatttacctagggacggattggcttggttttgtaaaaattaagtcggcagcgcccatacctggtgagtctggaatggtctctgggctcctgtttctgctcttttcctccacggactccaaaggcgggggttgaagactgggcagaggctacatgggggcggatggcaggaacagaaattgcaaatgaagaaatagcatttggaaattctgtgaagacatctggaacttccgtcctgtacctgactccacctccaggagaaggagcaggtggactggccgaaaaggagaggccatgcttttaggacagtagcccctcatcccgagaggagaggaagaggaggaagacagtgggagtcatcaggagaggagaatgaggatgaggcccaggagacaggctcatctgggagaagagggacccctgggacgaggaggtccctgctagtctcagccaggagcctggattgcccagcagcagcctccggcacccagcgcttggctgggccagcagcccctctgggggtggggcacgaacattttattgtaaaaaatgggatcattgacaacatttgggactttaaaaaactgctttcatttaaaattcatgcaaacttggacatatccttaccccaacctcccatgtctccctaagggagggaaaaatcaggaaacccttgggttggaaggagctcagaagctgtctagccattcccaggagggtaaagcccatcagcctccttggcctagagccaggagtttgggggcccaccttcctgggcttccaaggaactttaggaccagtaagaaaaaattcagctgttctaaattatctgttctgggtgctgatgaggtttcactttaaaacaatagaaagttttccagtgttaattcactttttgcaaatacctccttccaccctctttggttttgtaaaggtgggtgaaggttgttctagattatgtcatacgtgtttgaaaaatgccaaaataataataatgataataataatagaaacctttggatttgtcaggtgcatcacagaggtcaaagcacttcacggcctttcatgtactcgccctgagagggacagggttagagttattacagtcaattgacaaatgaggaaacaggttatggaagggaacaggcccacagtgagcagcatgctggtatccgcnaggcttcccagaaccctgctgcctccatgtgggctggggtggaaccacagagaggagaaaggaagaagaggagacctaggaatgaccttgtaacttttgttctttcaacaccagtaagtaaaactaacagctggacctcacagttcacagaacagttgaacataaattatctggtttaacccgatgaaatagaggttatttctcctatttgatccataaggaaatcaaggcttggaaaagtcaagtgacttgctaataagtgacagagccactcgaatcccaggctgtctgctgtctcgttcccctccatctgatccccacacaggctcacgtactgaagcatctgtgctctgtgccctatcttagcacctactatgtaattcaagagcaaaggggggccccaaggtgaaaataaggcactgaaaggctgtggtctggaagagcccaggtccagcacccctttttcagtatgagccccagttcagccggcctcagcctcttgctgtgatggagatccacaagcctagccaagcttggggagtcactgcaaaaggactgagcccaggagagcggggacagtcatgtgcctctggtaggatgggcacagttactggtaaggtcacagagatctagtgggaggtaccataggtagatacctccaaagattctagatggcacggtggtcaagctagacaaaaagtcagagctggaagggccgtctcattgaaggcaggcaagcaagagaggacaagggatgtagccgcctgacagtgagctacagcactggccccaggatgcaaacccctctctcctcctcatgccactgcctctccccaagtgcaacacctatggccaggatcaggggtacagatggctcgttaccagccaacccttttgaattcttctacttctacctgaccccctctcctcactggcctggggtcaagaagtttgagtctgggagctggattgcctgcaaatagtgaaagcctgaaacataatggtttgccatgttttgaaaaaaaatgcatatttaatttcttcctcatgagataggacagttgctgttctttcttacctggcaatgaccctaaaatgtatatcctctttcctgaatatttagcagagacacacacacctgtccagagcgtttttggtatgcaaagtactttgacattggttgccaaagtcctccattttatagatgaaaaaactaaggctcaggaggcttgagacttgctaaaaggtcacacagcttggaagtgattcttcaaatcctctgctctttctgctgccacctgctgggtctcttggcaagcatggagggaggggctaactgtactttatagagctgggaagcccagtctctgagctgagcagatttgtatgaactgctttgggccaggacctgtaatgagccctggggagggacccagaggcacatctaactggcagcacaaggaggatgagaatttgcaactaaaggcctcacttggacaaaacactttggggtcacaatgcccaggaccgaagacatgttcaaggacagcacgaggcatctttctattgggagacccatgtccttggtaagcctgcacacctggcttcctaatccctgagagcctgcccactgtccagatccagtgagttggtacaaaacgtacagactgaagtccctgggcttgcttttcccatgggtgaggaccagaaccagactctgagcatccttacccctggccacccgaattgttccaagtttgaggtaccccgttcccagagatctgggggtccttctttggagggcttgctttgttctgatggccttcagaaaggaatcacatgaagtataaaaggacaggccccttggtcaccaagttttggctcctcatacagataggactcatccaggttcccagcgaggcactgactaagcgaggctcagagcttccatatcaaattcctcagctttgttctgtgcccagagggggtgggccccattctgggccctgtgaactttgtcttatatatcaccatctgtatcagaattcctcctcaattgcagttaagtgaaaatacgtggaagtctgcttttccatcctgtattctcccacatcactactggctgtgcggcccccgctgcttgccaagcttgggaatccagagaggggcagtagtagagtgggccagttgggacccacccgcagagctgaagaaacacgccagactaactgatgggattccacaccggagcctctgagcgcacaggcaggcatgccaagggggctgcagggtttgtcctttacttatctgcccctttcctagaaaactcctcgtttctgaaattaggcattatatggttccaggacccagccttcaaaattcctggcaggccagcttcaacattccatggccagccctgcctaagccagacttgggtcccagtccctcagtctctccagtggatatcttctgtggtgcatgctgttgagtccaacccaaaggccaaccgaggcacacaggagttgggactggctgccacaaagctagaaagggacaaaacagcacttgcttccctatggccacatggatagtccctggatatccttgctgtggtagaggtcctctacccattccagccactgatagcagggggattttccttcctaaggagaacagatgtaacagctttgcaaagtaccggcccataggaatcaaatgggtgagatcagctttgggcctgaccccagcaagaccagcatctccagaccccagcctttctcctcaggcctaagagagtcagggaaagagaggagactgtcccagagaccttctcctcgggtcagccagatagtctggatctatggtgtgactcaagctcctccttacccagggggggtaaggccaggcctctagctacttggagttgtctgtaataatcttgaaaggcccaagggcctgtccccatcctgacttaaaggcatctgcttccctgtttcatatcacatgacagagaaacctgttctcatggcatgtaacatccctgtgaagagagcgttgtatatgattttgtattttttaattcattttaatctacaggttggaatctaatttttaaattttattggaactccccccccaacccgaatttcgagagactattataacaaccatacaccacaataataaaaaaa

SEQ ID NO: 286559 - DNA, 2187 bp, Homo sapiens
taactggtaatagaattgattcaaatgtgccttaatataggcgctggggctaactgtactttatagagctgggaagcccagtctctgagctgagcagatttgtatgaactgctttgggccaggacctgtaatgagccctggggagggacccagaggcacatctaactggcagcacaaggaggatgagaatttgcaactaaaggcctcacttggacaaaacactttggggtcacaatgcccaggaccgaagacatgttcaaggacagcacgaggcatctttctattgggagacccatgtccttggtaagcctgcacacctggcttcctaatccctgagagcctgcccactgtccagatccagtgagttggtacaaaacgtacagactgaagtccctgggcttgcttttcccatgggtgaggaccagaaccagactctgagcatccttacccctggccacccgaattgttccaagtttgaggtaccccgttcccagagatctgggggtccttctttggagggcttgctttgttctgatggccttcagaaaggaatcacatgaagtataaaaggacaggccccttggtcaccaagttttggctcctcatacagataggactcatccaggttcccagcgaggcactgactaagcgaggctcagagcttccatatcaaattcctcagctttgttctgtgcccagagggggtgggccccattctgggccctgtgaactttgtcttatatatcaccatctgtatcagaattcctcctcaattgcagttaagtgaaaatacgtggaagtctgcttttccatcctgtattctcccacatcactactggctgtgcggcccccgctgcttgccaagcttgggaatccagagaggggcagtagtagagtgggccagttgggacccacccgcagagctgaagaaacacgccagactaactgatgggattccacaccggagcctctgagcgcacaggcaggcatgccaagggggctgcagggtttgtcctttacttatctgcccctttcctagaaaactcctcgtttctgaaattaggcattatatggttccaggacccagccttcaaaattcctggcaggccagcttcaacattccatggccagccctgcctaagccagacttgggtcccagtccctcagtctctccagtggatatcttctgtggtgcatgctgttgagtccaacccaaaggccaaccgaggcacacaggagttgggactggctgccacaaagctagaaagggacaaaacagcacttgcttccctatggccacatggatagtccctggatatccttgctgtggtagaggtcctctacccattccagccactgatagcagggggattttccttcctaaggagaacagatgtaacagctttgcaaagtaccggcccataggaatcaaatgggtgagatcagctttgggcctgaccccagcaagaccagcatctccagaccccagcctttctcctcaggcctaagagagtcagggaaagagaggagactgtcccagagaccttctcctcgggtcagccagatagtctggatctatggtgtgactcaagctcctccttacccagggggggtaaggccaggcctctagctacttggagttgtctgtaataatcttgaaaggcccaagggcctgtccccatcctgacttaaaggcatctgcttccctgtttcatatcacatgacagagaaacctgttctcatggcatgtaacatccctgtgaagagagcgttgtatatgattttgtattttttaattcattttaatctacaggttggaatctaatttttaaattttattggaactcacattttaaaaagaaataaaatttaaaataataataataataataataataataataaacctttgaccagtgtcttccaagtagtttgatcaaagaatttataggtgttttcaaaacacagtccggagtgtaaagattggaaagccccatggccttgcctgtgtgtatgaagtgtaaatctggttttgttttgttgttttggattcttttgggtttttgttttgttttgaagatcagacagtgatcactctgaaagattgaagccaagaatttgtaactatggtatttactgtaagctgtagaacactcaataactattaaaaaaaaaaattccccccca

SEQ ID NO: 286560 - DNA, 5662 bp, Homo sapiens
  misc_feature (2584)..(2584): n is a, c, g, or t
aggcgggaggcaggcagcttcactaggaaggcacagcgggctcccgagttgaggggagaagcctcctgaatatcactgacactgtttctttcccctttccctctgcagatctggagtcacacattgtatgcaactactcaagtcttacaccggtgctggagcagttccctagcagcaccacctctatttgcaagaagagacaacggaagtgcaagggtcactttatgcatctttaatggttttgatttttatttttggtttttgtaaaagctgctttttctaatctcctgcctctccccaactgtccccctcttagcccctgcccttccagctctatccccttcctcctacctgaccaggccatgtcctctctgctcttccctaagtgtcctgtccctggggatcccagtctagaggcaagcagagagtagggtttattgcagtggttcatctgaaggctggattccatttgaagagcataaacagatgtggtccagggtaggaactcagagctgttgagcaggctacatctctaggggagtgttctggttgttttttcttaagcaagattagttcaggacattcccatgtcccagacacaaatgaaatgtctcctgagaaccattgcaacagaccaagaacaaaaccacctgagtatgtaggcgtgttattagcagcttaataccccaggctgagaacctggggaaaaaagtctttagaatttgggggagggtggggggagggagggcattgtggggaaggagagggaagaagggaggagcggtgcttgcctcatggctttggtttgaaaggtctctggccaaagcatctggccctggaccttctgatttgcacagtgatgttaactgacctggcacttcctcaaaaggtgattttgtccttagacctgccaagcggctgcagggtggtaggatcccagcatcccgaggccttggaaggccggatgccctgtgtcatccagacttcagcctctgagctgtcatggacccactctgatgaggagcttcctcctgattggagtgggaacctagggcatttctctcccttttcttttgcccttcccagtgccaggactcacctgtctgaccatagagcttgcaggcaggccaagctcttggttacctgtgccattcatggcccaagtgaaggaaccacattccaggtgggtgctggcagctctgaaggtgaggatagtgaaggaaaagcaatagcaataaacatttcatagactcatggaactgaagggaccttagcaatcatctcatccatttccctatttggcagatgaggaaactgaggcccagagaagcggaaaggacttccctagaccttacagtaaattagcattaaatgcagccttcctacctagtgggcaccttgcttacaaaaatttacctagggacggattggcttggttttgtaaaaattaagtcggcagcgcccatacctggtgagtctggaatggtctctgggctcctgtttctgctcttttcctccacggactccaaaggcgggggttgaagactgggcagaggctacatgggggcggatggcaggaacagaaattgcaaatgaagaaatagcatttggaaattctgtgaagacatctggaacttccgtcctgtacctgactccacctccaggagaaggagcaggtggactggccgaaaaggagaggccatgcttttaggacagtagcccctcatcccgagaggagaggaagaggaggaagacagtgggagtcatcaggagaggagaatgaggatgaggcccaggagacaggctcatctgggagaagagggacccctgggacgaggaggtccctgctagtctcagccaggagcctggattgcccagcagcagcctccggcacccagcgcttggctgggccagcagcccctctgggggtggggcacgaacattttattgtaaaaaatgggatcattgacaacatttgggactttaaaaaactgctttcatttaaaattcatgcaaacttggacatatccttaccccaacctcccatgtctccctaagggagggaaaaatcaggaaacccttgggttggaaggagctcagaagctgtctagccattcccaggagggtaaagcccatcagcctccttggcctagagccaggagtttgggggcccaccttcctgggcttccaaggaactttaggaccagtaagaaaaaattcagctgttctaaattatctgttctgggtgctgatgaggtttcactttaaaacaatagaaagttttccagtgttaattcactttttgcaaatacctccttccaccctctttggttttgtaaaggtgggtgaaggttgttctagattatgtcatacgtgtttgaaaaatgccaaaataataataatgataataataatagaaacctttggatttgtcaggtgcatcacagaggtcaaagcacttcacggcctttcatgtactcgccctgagagggacagggttagagttattacagtcaattgacaaatgaggaaacaggttatggaagggaacaggcccacagtgagcagcatgctggtatccgcnaggcttcccagaaccctgctgcctccatgtgggctggggtggaaccacagagaggagaaaggaagaagaggagacctaggaatgaccttgtaacttttgttctttcaacaccagtaagtaaaactaacagctggacctcacagttcacagaacagttgaacataaattatctggtttaacccgatgaaatagaggttatttctcctatttgatccataaggaaatcaaggcttggaaaagtcaagtgacttgctaataagtgacagagccactcgaatcccaggctgtctgctgtctcgttcccctccatctgatccccacacaggctcacgtactgaagcatctgtgctctgtgccctatcttagcacctactatgtaattcaagagcaaaggggggccccaaggtgaaaataaggcactgaaaggctgtggtctggaagagcccaggtccagcacccctttttcagtatgagccccagttcagccggcctcagcctcttgctgtgatggagatccacaagcctagccaagcttggggagtcactgcaaaaggactgagcccaggagagcggggacagtcatgtgcctctggtaggatgggcacagttactggtaaggtcacagagatctagtgggaggtaccataggtagatacctccaaagattctagatggcacggtggtcaagctagacaaaaagtcagagctggaagggccgtctcattgaaggcaggcaagcaagagaggacaagggatgtagccgcctgacagtgagctacagcactggccccaggatgcaaacccctctctcctcctcatgccactgcctctccccaagtgcaacacctatggccaggatcaggggtacagatggctcgttaccagccaacccttttgaattcttctacttctacctgaccccctctcctcactggcctggggtcaagaagtttgagtctgggagctggattgcctgcaaatagtgaaagcctgaaacataatggtttgccatgttttgaaaaaaaatgcatatttaatttcttcctcatgagataggacagttgctgttctttcttacctggcaatgaccctaaaatgtatatcctctttcctgaatatttagcagagacacacacacctgtccagagcgtttttggtatgcaaagtactttgacattggttgccaaagtcctccattttatagatgaaaaaactaaggctcaggaggcttgagacttgctaaaaggtcacacagcttggaagtgattcttcaaatcctctgctctttctgctgccacctgctgggtctcttggcaagcatggagggaggggctaactgtactttatagagctgggaagcccagtctctgagctgagcagatttgtatgaactgctttgggccaggacctgtaatgagccctggggagggacccagaggcacatctaactggcagcacaaggaggatgagaatttgcaactaaaggcctcacttggacaaaacactttggggtcacaatgcccaggaccgaagacatgttcaaggacagcacgaggcatctttctattgggagacccatgtccttggtaagcctgcacacctggcttcctaatccctgagagcctgcccactgtccagatccagtgagttggtacaaaacgtacagactgaagtccctgggcttgcttttcccatgggtgaggaccagaaccagactctgagcatccttacccctggccacccgaattgttccaagtttgaggtaccccgttcccagagatctgggggtccttctttggagggcttgctttgttctgatggccttcagaaaggaatcacatgaagtataaaaggacaggccccttggtcaccaagttttggctcctcatacagataggactcatccaggttcccagcgaggcactgactaagcgaggctcagagcttccatatcaaattcctcagctttgttctgtgcccagagggggtgggccccattctgggccctgtgaactttgtcttatatatcaccatctgtatcagaattcctcctcaattgcagttaagtgaaaatacgtggaagtctgcttttccatcctgtattctcccacatcactactggctgtgcggcccccgctgcttgccaagcttgggaatccagagaggggcagtagtagagtgggccagttgggacccacccgcagagctgaagaaacacgccagactaactgatgggattccacaccggagcctctgagcgcacaggcaggcatgccaagggggctgcagggtttgtcctttacttatctgcccctttcctagaaaactcctcgtttctgaaattaggcattatatggttccaggacccagccttcaaaattcctggcaggccagcttcaacattccatggccagccctgcctaagccagacttgggtcccagtccctcagtctctccagtggatatcttctgtggtgcatgctgttgagtccaacccaaaggccaaccgaggcacacaggagttgggactggctgccacaaagctagaaagggacaaaacagcacttgcttccctatggccacatggatagtccctggatatccttgctgtggtagaggtcctctacccattccagccactgatagcagggggattttccttcctaaggagaacagatgtaacagctttgcaaagtaccggcccataggaatcaaatgggtgagatcagctttgggcctgaccccagcaagaccagcatctccagaccccagcctttctcctcaggcctaagagagtcagggaaagagaggagactgtcccagagaccttctcctcgggtcagccagatagtctggatctatggtgtgactcaagctcctccttacccagggggggtaaggccaggcctctagctacttggagttgtctgtaataatcttgaaaggcccaagggcctgtccccatcctgacttaaaggcatctgcttccctgtttcatatcacatgacagagaaacctgttctcatggcatgtaacatccctgtgaagagggagcagaaggggatcctctaagtcagc

SEQ ID NO: 286561 - DNA, 5649 bp, Homo sapiens
  misc_feature (2584)..(2584): n is a, c, g, or t
aggcgggaggcaggcagcttcactaggaaggcacagcgggctcccgagttgaggggagaagcctcctgaatatcactgacactgtttctttcccctttccctctgcagatctggagtcacacattgtatgcaactactcaagtcttacaccggtgctggagcagttccctagcagcaccacctctatttgcaagaagagacaacggaagtgcaagggtcactttatgcatctttaatggttttgatttttatttttggtttttgtaaaagctgctttttctaatctcctgcctctccccaactgtccccctcttagcccctgcccttccagctctatccccttcctcctacctgaccaggccatgtcctctctgctcttccctaagtgtcctgtccctggggatcccagtctagaggcaagcagagagtagggtttattgcagtggttcatctgaaggctggattccatttgaagagcataaacagatgtggtccagggtaggaactcagagctgttgagcaggctacatctctaggggagtgttctggttgttttttcttaagcaagattagttcaggacattcccatgtcccagacacaaatgaaatgtctcctgagaaccattgcaacagaccaagaacaaaaccacctgagtatgtaggcgtgttattagcagcttaataccccaggctgagaacctggggaaaaaagtctttagaatttgggggagggtggggggagggagggcattgtggggaaggagagggaagaagggaggagcggtgcttgcctcatggctttggtttgaaaggtctctggccaaagcatctggccctggaccttctgatttgcacagtgatgttaactgacctggcacttcctcaaaaggtgattttgtccttagacctgccaagcggctgcagggtggtaggatcccagcatcccgaggccttggaaggccggatgccctgtgtcatccagacttcagcctctgagctgtcatggacccactctgatgaggagcttcctcctgattggagtgggaacctagggcatttctctcccttttcttttgcccttcccagtgccaggactcacctgtctgaccatagagcttgcaggcaggccaagctcttggttacctgtgccattcatggcccaagtgaaggaaccacattccaggtgggtgctggcagctctgaaggtgaggatagtgaaggaaaagcaatagcaataaacatttcatagactcatggaactgaagggaccttagcaatcatctcatccatttccctatttggcagatgaggaaactgaggcccagagaagcggaaaggacttccctagaccttacagtaaattagcattaaatgcagccttcctacctagtgggcaccttgcttacaaaaatttacctagggacggattggcttggttttgtaaaaattaagtcggcagcgcccatacctggtgagtctggaatggtctctgggctcctgtttctgctcttttcctccacggactccaaaggcgggggttgaagactgggcagaggctacatgggggcggatggcaggaacagaaattgcaaatgaagaaatagcatttggaaattctgtgaagacatctggaacttccgtcctgtacctgactccacctccaggagaaggagcaggtggactggccgaaaaggagaggccatgcttttaggacagtagcccctcatcccgagaggagaggaagaggaggaagacagtgggagtcatcaggagaggagaatgaggatgaggcccaggagacaggctcatctgggagaagagggacccctgggacgaggaggtccctgctagtctcagccaggagcctggattgcccagcagcagcctccggcacccagcgcttggctgggccagcagcccctctgggggtggggcacgaacattttattgtaaaaaatgggatcattgacaacatttgggactttaaaaaactgctttcatttaaaattcatgcaaacttggacatatccttaccccaacctcccatgtctccctaagggagggaaaaatcaggaaacccttgggttggaaggagctcagaagctgtctagccattcccaggagggtaaagcccatcagcctccttggcctagagccaggagtttgggggcccaccttcctgggcttccaaggaactttaggaccagtaagaaaaaattcagctgttctaaattatctgttctgggtgctgatgaggtttcactttaaaacaatagaaagttttccagtgttaattcactttttgcaaatacctccttccaccctctttggttttgtaaaggtgggtgaaggttgttctagattatgtcatacgtgtttgaaaaatgccaaaataataataatgataataataatagaaacctttggatttgtcaggtgcatcacagaggtcaaagcacttcacggcctttcatgtactcgccctgagagggacagggttagagttattacagtcaattgacaaatgaggaaacaggttatggaagggaacaggcccacagtgagcagcatgctggtatccgcnaggcttcccagaaccctgctgcctccatgtgggctggggtggaaccacagagaggagaaaggaagaagaggagacctaggaatgaccttgtaacttttgttctttcaacaccagtaagtaaaactaacagctggacctcacagttcacagaacagttgaacataaattatctggtttaacccgatgaaatagaggttatttctcctatttgatccataaggaaatcaaggcttggaaaagtcaagtgacttgctaataagtgacagagccactcgaatcccaggctgtctgctgtctcgttcccctccatctgatccccacacaggctcacgtactgaagcatctgtgctctgtgccctatcttagcacctactatgtaattcaagagcaaaggggggccccaaggtgaaaataaggcactgaaaggctgtggtctggaagagcccaggtccagcacccctttttcagtatgagccccagttcagccggcctcagcctcttgctgtgatggagatccacaagcctagccaagcttggggagtcactgcaaaaggactgagcccaggagagcggggacagtcatgtgcctctggtaggatgggcacagttactggtaaggtcacagagatctagtgggaggtaccataggtagatacctccaaagattctagatggcacggtggtcaagctagacaaaaagtcagagctggaagggccgtctcattgaaggcaggcaagcaagagaggacaagggatgtagccgcctgacagtgagctacagcactggccccaggatgcaaacccctctctcctcctcatgccactgcctctccccaagtgcaacacctatggccaggatcaggggtacagatggctcgttaccagccaacccttttgaattcttctacttctacctgaccccctctcctcactggcctggggtcaagaagtttgagtctgggagctggattgcctgcaaatagtgaaagcctgaaacataatggtttgccatgttttgaaaaaaaatgcatatttaatttcttcctcatgagataggacagttgctgttctttcttacctggcaatgaccctaaaatgtatatcctctttcctgaatatttagcagagacacacacacctgtccagagcgtttttggtatgcaaagtactttgacattggttgccaaagtcctccattttatagatgaaaaaactaaggctcaggaggcttgagacttgctaaaaggtcacacagcttggaagtgattcttcaaatcctctgctctttctgctgccacctgctgggtctcttggcaagcatggagggaggggctaactgtactttatagagctgggaagcccagtctctgagctgagcagatttgtatgaactgctttgggccaggacctgtaatgagccctggggagggacccagaggcacatctaactggcagcacaaggaggatgagaatttgcaactaaaggcctcacttggacaaaacactttggggtcacaatgcccaggaccgaagacatgttcaaggacagcacgaggcatctttctattgggagacccatgtccttggtaagcctgcacacctggcttcctaatccctgagagcctgcccactgtccagatccagtgagttggtacaaaacgtacagactgaagtccctgggcttgcttttcccatgggtgaggaccagaaccagactctgagcatccttacccctggccacccgaattgttccaagtttgaggtaccccgttcccagagatctgggggtccttctttggagggcttgctttgttctgatggccttcagaaaggaatcacatgaagtataaaaggacaggccccttggtcaccaagttttggctcctcatacagataggactcatccaggttcccagcgaggcactgactaagcgaggctcagagcttccatatcaaattcctcagctttgttctgtgcccagagggggtgggccccattctgggccctgtgaactttgtcttatatatcaccatctgtatcagaattcctcctcaattgcagttaagtgaaaatacgtggaagtctgcttttccatcctgtattctcccacatcactactggctgtgcggcccccgctgcttgccaagcttgggaatccagagaggggcagtagtagagtgggccagttgggacccacccgcagagctgaagaaacacgccagactaactgatgggattccacaccggagcctctgagcgcacaggcaggcatgccaagggggctgcagggtttgtcctttacttatctgcccctttcctagaaaactcctcgtttctgaaattaggcattatatggttccaggacccagccttcaaaattcctggcaggccagcttcaacattccatggccagccctgcctaagccagacttgggtcccagtccctcagtctctccagtggatatcttctgtggtgcatgctgttgagtccaacccaaaggccaaccgaggcacacaggagttgggactggctgccacaaagctagaaagggacaaaacagcacttgcttccctatggccacatggatagtccctggatatccttgctgtggtagaggtcctctacccattccagccactgatagcagggggattttccttcctaaggagaacagatgtaacagctttgcaaagtaccggcccataggaatcaaatgggtgagatcagctttgggcctgaccccagcaagaccagcatctccagaccccagcctttctcctcaggcctaagagagtcagggaaagagaggagactgtcccagagaccttctcctcgggtcagccagatagtctggatctatggtgtgactcaagctcctccttacccagggggggtaaggccaggcctctagctacttggagttgtctgtaataatcttgaaaggcccaagggcctgtccccatcctgacttaaaggcatctgcttccctggtttacctggcagagccgttcttaatggatggaaccaatcctgggtagagactttgttatggatttgtttttt

SEQ ID NO: 286562 - DNA, 1702 bp, Homo sapiens
ggggcagattcaggtcctccccatgctccgccgggcttgctttgttctgatggccttcagaaaggaatcacatgaagtataaaaggacaggccccttggtcaccaagttttggctcctcatacagataggactcatccaggttcccagcgaggcactgactaagcgaggctcagagcttccatatcaaattcctcagctttgttctgtgcccagagggggtgggccccattctgggccctgtgaactttgtcttatatatcaccatctgtatcagaattcctcctcaattgcagttaagtgaaaatacgtggaagtctgcttttccatcctgtattctcccacatcactactggctgtgcggcccccgctgcttgccaagcttgggaatccagagaggggcagtagtagagtgggccagttgggacccacccgcagagctgaagaaacacgccagactaactgatgggattccacaccggagcctctgagcgcacaggcaggcatgccaagggggctgcagggtttgtcctttacttatctgcccctttcctagaaaactcctcgtttctgaaattaggcattatatggttccaggacccagccttcaaaattcctggcaggccagcttcaacattccatggccagccctgcctaagccagacttgggtcccagtccctcagtctctccagtggatatcttctgtggtgcatgctgttgagtccaacccaaaggccaaccgaggcacacaggagttgggactggctgccacaaagctagaaagggacaaaacagcacttgcttccctatggccacatggatagtccctggatatccttgctgtggtagaggtcctctacccattccagccactgatagcagggggattttccttcctaaggagaacagatgtaacagctttgcaaagtaccggcccataggaatcaaatgggtgagatcagctttgggcctgaccccagcaagaccagcatctccagaccccagcctttctcctcaggcctaagagagtcagggaaagagaggagactgtcccagagaccttctcctcgggtcagccagatagtctggatctatggtgtgactcaagctcctccttacccagggggggtaaggccaggcctctagctacttggagttgtctgtaataatcttgaaaggcccaagggcctgtccccatcctgacttaaaggcatctgcttccctgtttcatatcacatgacagagaaacctgttctcatggcatgtaacatccctgtgaagagagcgttgtatatgattttgtattttttaattcattttaatctacaggttggaatctaatttttaaattttattggaactcacattttaaaaagaaataaaatttaaaataataataataataataataataataataaacctttgaccagtgtcttccaagtagtttgatcaaagaatttataggtgttttcaaaacacagtccggagtgtaaagattggaaagccccatggccttgcctgtgtgtatgaagtgtaaatctggttttgttttgttgttttggattcttttgggtttttgttttgttttgaagatcagacagtgatcactctgaaagattgaagccaagaatttgtaactatggtatttactgtaagctgtagaacactcaataactattaaaaaaaaaaattccccccca

SEQ ID NO: 286563 - DNA, 1794 bp, Homo sapiens
tctgtacagcgactacgggagtgacaatgtacaaccagactctgagcatccttacccctggccacccgaattgttccaagtttgaggtaccccgttcccagagatctgggggtccttctttggagggcttgctttgttctgatggccttcagaaaggaatcacatgaagtataaaaggacaggccccttggtcaccaagttttggctcctcatacagataggactcatccaggttcccagcgaggcactgactaagcgaggctcagagcttccatatcaaattcctcagctttgttctgtgcccagagggggtgggccccattctgggccctgtgaactttgtcttatatatcaccatctgtatcagaattcctcctcaattgcagttaagtgaaaatacgtggaagtctgcttttccatcctgtattctcccacatcactactggctgtgcggcccccgctgcttgccaagcttgggaatccagagaggggcagtagtagagtgggccagttgggacccacccgcagagctgaagaaacacgccagactaactgatgggattccacaccggagcctctgagcgcacaggcaggcatgccaagggggctgcagggtttgtcctttacttatctgcccctttcctagaaaactcctcgtttctgaaattaggcattatatggttccaggacccagccttcaaaattcctggcaggccagcttcaacattccatggccagccctgcctaagccagacttgggtcccagtccctcagtctctccagtggatatcttctgtggtgcatgctgttgagtccaacccaaaggccaaccgaggcacacaggagttgggactggctgccacaaagctagaaagggacaaaacagcacttgcttccctatggccacatggatagtccctggatatccttgctgtggtagaggtcctctacccattccagccactgatagcagggggattttccttcctaaggagaacagatgtaacagctttgcaaagtaccggcccataggaatcaaatgggtgagatcagctttgggcctgaccccagcaagaccagcatctccagaccccagcctttctcctcaggcctaagagagtcagggaaagagaggagactgtcccagagaccttctcctcgggtcagccagatagtctggatctatggtgtgactcaagctcctccttacccagggggggtaaggccaggcctctagctacttggagttgtctgtaataatcttgaaaggcccaagggcctgtccccatcctgacttaaaggcatctgcttccctgtttcatatcacatgacagagaaacctgttctcatggcatgtaacatccctgtgaagagagcgttgtatatgattttgtattttttaattcattttaatctacaggttggaatctaatttttaaattttattggaactcacattttaaaaagaaataaaatttaaaataataataataataataataataataataaacctttgaccagtgtcttccaagtagtttgatcaaagaatttataggtgttttcaaaacacagtccggagtgtaaagattggaaagccccatggccttgcctgtgtgtatgaagtgtaaatctggttttgttttgttgttttggattcttttgggtttttgttttgttttgaagatcagacagtgatcactctgaaagattgaagccaagaatttgtaactatggtatttactgtaagctgtagaacactcaataactattaaaaaaaaaaattccccccca

SEQ ID NO: 286564 - DNA, 1390 bp, Homo sapiens
aaggatccgcagtagtggcagcagtagtggtgccactactggctgtgcggcccccgctgcttgccaagcttgggaatccagagaggggcagtagtagagtgggccagttgggacccacccgcagagctgaagaaacacgccagactaactgatgggattccacaccggagcctctgagcgcacaggcaggcatgccaagggggctgcagggtttgtcctttacttatctgcccctttcctagaaaactcctcgtttctgaaattaggcattatatggttccaggacccagccttcaaaattcctggcaggccagcttcaacattccatggccagccctgcctaagccagacttgggtcccagtccctcagtctctccagtggatatcttctgtggtgcatgctgttgagtccaacccaaaggccaaccgaggcacacaggagttgggactggctgccacaaagctagaaagggacaaaacagcacttgcttccctatggccacatggatagtccctggatatccttgctgtggtagaggtcctctacccattccagccactgatagcagggggattttccttcctaaggagaacagatgtaacagctttgcaaagtaccggcccataggaatcaaatgggtgagatcagctttgggcctgaccccagcaagaccagcatctccagaccccagcctttctcctcaggcctaagagagtcagggaaagagaggagactgtcccagagaccttctcctcgggtcagccagatagtctggatctatggtgtgactcaagctcctccttacccagggggggtaaggccaggcctctagctacttggagttgtctgtaataatcttgaaaggcccaagggcctgtccccatcctgacttaaaggcatctgcttccctgtttcatatcacatgacagagaaacctgttctcatggcatgtaacatccctgtgaagagagcgttgtatatgattttgtattttttaattcattttaatctacaggttggaatctaatttttaaattttattggaactcacattttaaaaagaaataaaatttaaaataataataataataataataataataataaacctttgaccagtgtcttccaagtagtttgatcaaagaatttataggtgttttcaaaacacagtccggagtgtaaagattggaaagccccatggccttgcctgtgtgtatgaagtgtaaatctggttttgttttgttgttttggattcttttgggtttttgttttgttttgaagatcagacagtgatcactctgaaagattgaagccaagaatttgtaactatggtatttactgtaagctgtagaacactcaataactattaaaaaaaaaaattccccccca

SEQ ID NO: 286565 - DNA, 2245 bp, Homo sapiens
gcagacttgatggctcccggccccccgacccggcccggcctggcggcgccgcaccggccacctcctgtctcacctgccgccactgcccgccgcgaccgccctctacacccggtgtcccgcgaccggaagagagcaaggccgcgccgcggagcaccacgggatcgaggaagactccgcccgcacccggccgcacggaggtcaccgtggagcggaaaagggtagcgctgcgaacgtcgtaaaatgccgggccgggctgctttccggcaggcgttggagaggctgctttccggcggcgccgggcgagaagcgcgactggagtctggggctgcggcttcccagaggcgcgagtcgcttttccaggagccgaggcccaaacggggccgggcctgaagggtcccccgccagcccgcggccgcgccatcaatcgccgccgcctcgtcccgcttctcggctgaggcgccgcgcggccaggcagcgggtccaggcctcagccgcgcgcccaggggcctccggggccctcccgggtcagcatgcccggggtgaaactgaccacccaggcctactgcaagatggtgctgcacggcgccaagtacccgcactgcgccgtcaacgggctcctggtggccgagaagcagaagccgcgtaaggagcacctccccctgggcggccccggcgcccaccacaccctcttcgtggactgcatccccctcttccacggcaccctggccctcgcccccatgctggaggtggctctcaccctgattgattcatggtgcaaagatcatagctacgtgattgctggttattatcaagctaatgagcgagtaaaggatgccagtccaaaccaggttgcagagaaggtggcctccagaatcgccgagggcttcagcgacactgcgctcatcatggtagacaacaccaagtttacgatggactgcgtagcgcctacgatccacgtgtacgagcaccatgagaacagatggcggtgcagagacccacaccatgactactgtgaagactggccagaggcacagaggatctcagcctcgctcctggacagccggtcctacgagacgctcgtggatttcgataaccacctggatgacattcggaatgactggacaaacccagagatcaataaagctgtcctacacttgtgctaggcaggcaccgctgtgactgggctccgggcctttccactacgttgaagaagaaaacctatttttaaatgtaaataaaatatctggtagcctgtgtggaaagctgaccgttttaagaagtggcatgtgccttgaaagggggcagaatgttcagtcggtcgtgtttttaacacagagtctctagaagaggtgcagacatcccgtctgactgtccctgtggactctctcagttgtatgttgctataatcctccaaatcaaagctctttctgcttgtgcaagattgttcctattaaacagttttaactaaccttttataatctggagagaatactttttaaggcttttgaactatctttttttaaaaaaaaaaaaaagcccacatcttatactccaatgagtgtgtttgtgagtttttatcctgtttgaattttgatgtcgtccaggcgtcctgggatcagggtagacacgtggagtgctggtgctgagctgtttgagaagctctgtgtgggtgtttctgtggtcaggtaggctgggctgtgaacagcactgctccacatggtgtcggctcacagagccaccgcaactctgcccagcgggagtgacaccactgatgccacagaagcctttatcgttaggggcaaaagcagacatctctggtagcaggagctcagtgtggtgctcttcagccacgcagaaagctcacgtgcctgcagggccaggaaagggaaatgatcgtttcttttgtattaggaaaaacaagacttagacttcccgagttgtgcagagtgacgtctgtactttttatacttagaacatttggtcaagttttgtaaccaaaccttagggaattgagagggaaactttatggtacgtttaccttttttcctttttatatgaattattttgtacaaagttcagagagcggtacctttcctactgtcttttctttgactccatggaggaatttgtaacgatcggtgtgacctgaaagggtttgtgatacagcggtcactattttctcttaacacataggaaaaaagttcagacatcgctacaataaatgtgctttatttgatccaccaaa

SEQ ID NO: 286566 - DNA, 576 bp, Homo sapiens
acccacaggtcttcccaccccaggcgctagagcacagacactcttcccaggcctgtgctttgatgtatctgtggccactcagaaagcttcagtcatctgcctccaactttctcagaattccacgtgaaaggcgtcccttccatgtattaaccatgtcttctatgctctgtatacctcttcatgcgtttgaaatgcacatgtttctcagtactctgcaccatctctgttcataccactgtgcatgtggctggccttctctcttgatgctgttacaagccgcccgttttcactgttagatgctgacttcttcatgtttgacccgtagtgactactgtgaagactggccagaggcacagaggatctcagcctcgctcctggacagccggtcctacgagacgctcgtggatttcgataaccacctggatgacattcggaatgactggacaaacccagagatcaataaagctgtcctacacttgtgctaggcaggcaccgctgtgactgggctccgggcctttccactacgttgaagaagaaaacctatttttaaatgtaaataaaatatctggtagcctg

SEQ ID NO: 286567 - DNA, 657 bp, Homo sapiens
cggcacgaggcacgtgcagcctgttggctccgccagtctttctgtcattgcttgttaagtctcagtggtgttgactgtgccttttgtaaacagtgttgaatggcattaactggaatgtggtagcctgactatttctttgacagtccaaaccaggttgcagagaaggtggcctccagaatcgccgagggcttcagcgacactgcgctcatcatggtaagtcgcttctgtgcagcatgtgggaggcccttgcgcctcctctcaccaacctggagcttgctctgcggcggtttcctttccgctaaccccttcactcatttatctgcttgagaccattgccgcctcttgcagttttctctcagctgcagaccagttgaatcccaggccatggcttctgtgcttccgcatcactacacaagtgggagtggggtcccctgccagccgcagcacctgggaacttgttagaaatgcgaattcccaggcacccaccccagaccccactgaatcagaaatgcgggggtttagcccagcagtccatgttaagacaccttctagatgattctggtctgaacatgccaagtgtgagaagcacaattagaacagccagcacagcctctaggggcacagggaaggaaggtccttgtatgtgagcagatgaca

SEQ ID NO: 286568 - DNA, 806 bp, Homo sapiens
aaaaaaaagcaaaaaaaaacactaaaatgtaactgggtgtggtggcctgtgcctatagtcccagctactcaggaggcagaggtgggattgcttgagcctaggaatttgaggttacagtgggctatgattgcatcactacactccagctagggcaacagagcaagaccctatctctaccaagccagtctttctgtcattgcttgttaagtctcagtggtgttgactgtgccttttgtaaacagtgttgaatggcattaactggaatgtggtagcctgactatttctttgacagtccaaaccaggttgcagagaaggtggcctccagaatcgccgagggcttcagcgacactgcgctcatcatggtaagtcgcttctgtgcagcatgtgggaggcccttgcgcctcctctcaccaacctggagcttgctctgcggcggtttcctttccgctaaccccttcactcatttatctgcttgagaccattgccgcctcttgcagttttctctcagctgcagaccagttgaatcccaggccatggcttctgtgcttccgcatcactacacaagtgggagtggggtcccctgccagccgcagcacctgggaacttgttagaaatgcgaattcccaggcacccaccccagaccccactgaatcagaaatgcgggggtttagcccagcagtccatgttaagacaccttctagatgattctggtctgaacatgccaagtgtgagaagcacaattagaacagccagcacagcctctaggggcacagggaaggaaggtccttgtatgtgagcagatgaca

SEQ ID NO: 286569 - DNA, 1467 bp, Homo sapiens
gcagacttgatggctcccggccccccgacccggcccggcctggcggcgccgcaccggccacctcctgtctcacctgccgccactgcccgccgcgaccgccctctacacccggtgtcccgcgaccggaagagagcaaggccgcgccgcggagcaccacgggatcgaggaagactccgcccgcacccggccgcacggaggtcaccgtggagcggaaaagggtagcgctgcgaacgtcgtaaaatgccgggccgggctgctttccggcaggcgttggagaggctgctttccggcggcgccgggcgagaagcgcgactggagtctggggctgcggcttcccagaggcgcgagtcgcttttccaggagccgaggcccaaacggggccgggcctgaagggtcccccgccagcccgcggccgcgccatcaatcgccgccgcctcgtcccgcttctcggctgaggcgccgcgcggccaggcagcgggtccaggcctcagccgcgcgcccaggggcctccggggccctcccgggtcagcatgcccggggtgaaactgaccacccaggcctactgcaagatggtgctgcacggcgccaagtacccgcactgcgccgtcaacgggctcctggtggccgagaagcagaagccgcgtaaggagcacctccccctgggcggccccggcgcccaccacaccctcttcgtggactgcatccccctcttccacggcaccctggccctcgcccccatgctggaggtggctctcaccctgattgattcatggtgcaaagatcatagctacgtgattgctggttattatcaagctaatgagcgagtaaaggatgccagtccaaaccaggttgcagagaaggtggcctccagaatcgccgagggcttcagcgacactgcgctcatcatggtagacaacaccaagtttacgatggactgcgtagcgcctacgatccacgtgtacgagcaccatgagaacagatggcggtgcagagacccacaccatgactactgtgaagactggccagaggcacagaggatctcagcctcgctcctggacagccggtcctacgagacgctcgtggatttcgataaccacctggatgacattcggaatgactggacaaacccagagatcaataaagctgtcctacacttgtgctaggcaggcaccgctgtgactgggctccgggcctttccactacgttgaagaagaaaacctatttttaaatgtaaataaaatatctggtagcctgtgtggaaagctgaccgttttaagaagtggcatgtgccttgaaagggggcagaatgttcagtcggtcgtgtttttaacacagagtctctagaagaggtgcagacatcccgtctgactgtccctgtggactctctcagttgtatgttgctataatcctccaaatcaaagctctttctgcttgtgcaagattgttcctattaaacagttttaacta

SEQ ID NO: 286570 - DNA, 1254 bp, Homo sapiens
gcagacttgatggctcccggccccccgacccggcccggcctggcggcgccgcaccggccacctcctgtctcacctgccgccactgcccgccgcgaccgccctctacacccggtgtcccgcgaccggaagagagcaaggccgcgccgcggagcaccacgggatcgaggaagactccgcccgcacccggccgcacggaggtcaccgtggagcggaaaagggtagcgctgcgaacgtcgtaaaatgccgggccgggctgctttccggcaggcgttggagaggctgctttccggcggcgccgggcgagaagcgcgactggagtctggggctgcggcttcccagaggcgcgagtcgcttttccaggagccgaggcccaaacggggccgggcctgaagggtcccccgccagcccgcggccgcgccatcaatcgccgccgcctcgtcccgcttctcggctgaggcgccgcgcggccaggcagcgggtccaggcctcagccgcgcgcccaggggcctccggggccctcccgggtcagcatgcccggggtgaaactgaccacccaggcctactgcaagatggtgctgcacggcgccaagtacccgcactgcgccgtcaacgggctcctggtggccgagaagcagaagccgcgtaaggagcacctccccctgggcggccccggcgcccaccacaccctcttcgtggactgcatccccctcttccacggcaccctggccctcgcccccatgctggaggtggctctcaccctgattgattcatggtgcaaagatcatagctacgtgattgctggttattatcaagctaatgagcgagtaaaggatgccagtccaaaccaggttgcagagaaggtggcctccagaatcgccgagggcttcagcgacactgcgctcatcatggtagacaacaccaagtttacgatggactgcgtagcgcctacgatccacgtgtacgagcaccatgagaacagatggcggtgcagagacccacaccatgactactgtgaagactggccagaggcacagaggatctcagcctcgctcctggacagccggtcctacgagacgctcgtggatttcgataaccacctggatgacattcggaatgactggacaaacccagagatcaataaagctgtcctacacttgtgctaggcaggcaccgctgtgactgggctccgggcctttccactacgttgaagaagaaaacctatttttaaatgtaaataaaatatctggtagcctg

SEQ ID NO: 286571 - DNA, 2150 bp, Homo sapiens
gcagacttgatggctcccggccccccgacccggcccggcctggcggcgccgcaccggccacctcctgtctcacctgccgccactgcccgccgcgaccgccctctacacccggtgtcccgcgaccggaagagagcaaggccgcgccgcggagcaccacgggatcgaggaagactccgcccgcacccggccgcacggaggtcaccgtggagcggaaaagggtagcgctgcgaacgtcgtaaaatgccgggccgggctgctttccggcaggcgttggagaggctgctttccggcggcgccgggcgagaagcgcgactggagtctggggctgcggcttcccagaggcgcgagtcgcttttccaggagccgaggcccaaacggggccgggcctgaagggtcccccgccagcccgcggccgcgccatcaatcgccgccgcctcgtcccgcttctcggctgaggcgccgcgcggccaggcagcgggtccaggcctcagccgcgcgcccaggggcctccggggccctcccgggtcagcatgcccggggtgaaactgaccacccaggcctactgcaagatggtgctgcacggcgccaagtacccgcactgcgccgtcaacgggctcctggtggccgagaagcagaagccgcgtaaggagcacctccccctgggcggccccggcgcccaccacaccctcttcgtggactgcatccccctcttccacggcaccctggccctcgcccccatgctggaggtggctctcaccctgattgattcatggtgcaaagatcatagctacgtgattgctggttattatcaagctaatgagcgagtaaaggatgccagtccaaaccaggttgcagagaaggtggcctccagaatcgccgagggcttcagcgacactgcgctcatcatgtgactactgtgaagactggccagaggcacagaggatctcagcctcgctcctggacagccggtcctacgagacgctcgtggatttcgataaccacctggatgacattcggaatgactggacaaacccagagatcaataaagctgtcctacacttgtgctaggcaggcaccgctgtgactgggctccgggcctttccactacgttgaagaagaaaacctatttttaaatgtaaataaaatatctggtagcctgtgtggaaagctgaccgttttaagaagtggcatgtgccttgaaagggggcagaatgttcagtcggtcgtgtttttaacacagagtctctagaagaggtgcagacatcccgtctgactgtccctgtggactctctcagttgtatgttgctataatcctccaaatcaaagctctttctgcttgtgcaagattgttcctattaaacagttttaactaaccttttataatctggagagaatactttttaaggcttttgaactatctttttttaaaaaaaaaaaaaagcccacatcttatactccaatgagtgtgtttgtgagtttttatcctgtttgaattttgatgtcgtccaggcgtcctgggatcagggtagacacgtggagtgctggtgctgagctgtttgagaagctctgtgtgggtgtttctgtggtcaggtaggctgggctgtgaacagcactgctccacatggtgtcggctcacagagccaccgcaactctgcccagcgggagtgacaccactgatgccacagaagcctttatcgttaggggcaaaagcagacatctctggtagcaggagctcagtgtggtgctcttcagccacgcagaaagctcacgtgcctgcagggccaggaaagggaaatgatcgtttcttttgtattaggaaaaacaagacttagacttcccgagttgtgcagagtgacgtctgtactttttatacttagaacatttggtcaagttttgtaaccaaaccttagggaattgagagggaaactttatggtacgtttaccttttttcctttttatatgaattattttgtacaaagttcagagagcggtacctttcctactgtcttttctttgactccatggaggaatttgtaacgatcggtgtgacctgaaagggtttgtgatacagcggtcactattttctcttaacacataggaaaaaagttcagacatcgctacaataaatgtgctttatttgatccaccaaa

SEQ ID NO: 286572 - DNA, 2029 bp, Homo sapiens
gcagacttgatggctcccggccccccgacccggcccggcctggcggcgccgcaccggccacctcctgtctcacctgccgccactgcccgccgcgaccgccctctacacccggtgtcccgcgaccggaagagagcaaggccgcgccgcggagcaccacgggatcgaggaagactccgcccgcacccggccgcacggaggtcaccgtggagcggaaaagggtagcgctgcgaacgtcgtaaaatgccgggccgggctgctttccggcaggcgttggagaggctgctttccggcggcgccgggcgagaagcgcgactggagtctggggctgcggcttcccagaggcgcgagtcgcttttccaggagccgaggcccaaacggggccgggcctgaagggtcccccgccagcccgcggccgcgccatcaatcgccgccgcctcgtcccgcttctcggctgaggcgcccaccacaccctcttcgtggactgcatccccctcttccacggcaccctggccctcgcccccatgctggaggtggctctcaccctgattgattcatggtgcaaagatcatagctacgtgattgctggttattatcaagctaatgagcgagtaaaggatgccagtccaaaccaggttgcagagaaggtggcctccagaatcgccgagggcttcagcgacactgcgctcatcatggtagacaacaccaagtttacgatggactgcgtagcgcctacgatccacgtgtacgagcaccatgagaacagatggcggtgcagagacccacaccatgactactgtgaagactggccagaggcacagaggatctcagcctcgctcctggacagccggtcctacgagacgctcgtggatttcgataaccacctggatgacattcggaatgactggacaaacccagagatcaataaagctgtcctacacttgtgctaggcaggcaccgctgtgactgggctccgggcctttccactacgttgaagaagaaaacctatttttaaatgtaaataaaatatctggtagcctgtgtggaaagctgaccgttttaagaagtggcatgtgccttgaaagggggcagaatgttcagtcggtcgtgtttttaacacagagtctctagaagaggtgcagacatcccgtctgactgtccctgtggactctctcagttgtatgttgctataatcctccaaatcaaagctctttctgcttgtgcaagattgttcctattaaacagttttaactaaccttttataatctggagagaatactttttaaggcttttgaactatctttttttaaaaaaaaaaaaaagcccacatcttatactccaatgagtgtgtttgtgagtttttatcctgtttgaattttgatgtcgtccaggcgtcctgggatcagggtagacacgtggagtgctggtgctgagctgtttgagaagctctgtgtgggtgtttctgtggtcaggtaggctgggctgtgaacagcactgctccacatggtgtcggctcacagagccaccgcaactctgcccagcgggagtgacaccactgatgccacagaagcctttatcgttaggggcaaaagcagacatctctggtagcaggagctcagtgtggtgctcttcagccacgcagaaagctcacgtgcctgcagggccaggaaagggaaatgatcgtttcttttgtattaggaaaaacaagacttagacttcccgagttgtgcagagtgacgtctgtactttttatacttagaacatttggtcaagttttgtaaccaaaccttagggaattgagagggaaactttatggtacgtttaccttttttcctttttatatgaattattttgtacaaagttcagagagcggtacctttcctactgtcttttctttgactccatggaggaatttgtaacgatcggtgtgacctgaaagggtttgtgatacagcggtcactattttctcttaacacataggaaaaaagttcagacatcgctacaataaatgtgctttatttgatccaccaaa

SEQ ID NO: 286573 - DNA, 1231 bp, Homo sapiens
agaccattatttcttctttattgatctcagcctcgctcctggacagccggtcctacgagacgctcgtggatttcgataaccacctggatgacattcggaatgactggacaaacccagagatcaataaagctgtcctacacttgtgctaggcaggcaccgctgtgactgggctccgggcctttccactacgttgaagaagaaaacctatttttaaatgtaaataaaatatctggtagcctgtgtggaaagctgaccgttttaagaagtggcatgtgccttgaaagggggcagaatgttcagtcggtcgtgtttttaacacagagtctctagaagaggtgcagacatcccgtctgactgtccctgtggactctctcagttgtatgttgctataatcctccaaatcaaagctctttctgcttgtgcaagattgttcctattaaacagttttaactaaccttttataatctggagagaatactttttaaggcttttgaactatctttttttaaaaaaaaaaaaaagcccacatcttatactccaatgagtgtgtttgtgagtttttatcctgtttgaattttgatgtcgtccaggcgtcctgggatcagggtagacacgtggagtgctggtgctgagctgtttgagaagctctgtgtgggtgtttctgtggtcaggtaggctgggctgtgaacagcactgctccacatggtgtcggctcacagagccaccgcaactctgcccagcgggagtgacaccactgatgccacagaagcctttatcgttaggggcaaaagcagacatctctggtagcaggagctcagtgtggtgctcttcagccacgcagaaagctcacgtgcctgcagggccaggaaagggaaatgatcgtttcttttgtattaggaaaaacaagacttagacttcccgagttgtgcagagtgacgtctgtactttttatacttagaacatttggtcaagttttgtaaccaaaccttagggaattgagagggaaactttatggtacgtttaccttttttcctttttatatgaattattttgtacaaagttcagagagcggtacctttcctactgtcttttctttgactccatggaggaatttgtaacgatcggtgtgacctgaaagggtttgtgatacagcggtcactattttctcttaacacataggaaaaaagttcagacatcgctacaataaatgtgctttatttgatccaccaaa

SEQ ID NO: 286574 - DNA, 1401 bp, Homo sapiens
aattgcccgaagggcattcagactagtctgcgctcatgttattgtacactacatccaacgtttacggaatggactgcgtacggcctatcttcaatccacgtatacttactcaccctaatgtaggcagcagtatggcggtgcaaggagacgcacacccatgagcatacgtgtagtaaggactgtgccgctctcttttacaagatctcactctcctgaccggtcctacgagacgctcgtggatttcgataaccacctggatgacattcggaatgactggacaaacccagagatcaataaagctgtcctacacttgtgctaggcaggcaccgctgtgactgggctccgggcctttccactacgttgaagaagaaaacctatttttaaatgtaaataaaatatctggtagcctgtgtggaaagctgaccgttttaagaagtggcatgtgccttgaaagggggcagaatgttcagtcggtcgtgtttttaacacagagtctctagaagaggtgcagacatcccgtctgactgtccctgtggactctctcagttgtatgttgctataatcctccaaatcaaagctctttctgcttgtgcaagattgttcctattaaacagttttaactaaccttttataatctggagagaatactttttaaggcttttgaactatctttttttaaaaaaaaaaaaaagcccacatcttatactccaatgagtgtgtttgtgagtttttatcctgtttgaattttgatgtcgtccaggcgtcctgggatcagggtagacacgtggagtgctggtgctgagctgtttgagaagctctgtgtgggtgtttctgtggtcaggtaggctgggctgtgaacagcactgctccacatggtgtcggctcacagagccaccgcaactctgcccagcgggagtgacaccactgatgccacagaagcctttatcgttaggggcaaaagcagacatctctggtagcaggagctcagtgtggtgctcttcagccacgcagaaagctcacgtgcctgcagggccaggaaagggaaatgatcgtttcttttgtattaggaaaaacaagacttagacttcccgagttgtgcagagtgacgtctgtactttttatacttagaacatttggtcaagttttgtaaccaaaccttagggaattgagagggaaactttatggtacgtttaccttttttcctttttatatgaattattttgtacaaagttcagagagcggtacctttcctactgtcttttctttgactccatggaggaatttgtaacgatcggtgtgacctgaaagggtttgtgatacagcggtcactattttctcttaacacataggaaaaaagttcagacatcgctacaataaatgtgctttatttgatccaccaaa

SEQ ID NO: 286575 - DNA, 902 bp, Homo sapiens
gcagacttgatggctcccggccccccgacccggcccggcctggcggcgccgcaccggccacctcctgtctcacctgccgccactgcccgccgcgaccgccctctacacccggtgtcccgcgaccggaagagagcaaggccgcgccgcggagcaccacgggatcgaggaagactccgcccgcacccggccgcacggaggtcaccgtggagcggaaaagggtagcgctgcgaacgtcgtaaaatgccgggccgggctgctttccggcaggcgttggagaggctgctttccggcggcgccgggcgagaagcgcgactggagtctggggctgcggcttcccagaggcgcgagtcgcttttccaggagccgaggcccaaacggggccgggcctgaagggtcccccgccagcccgcggccgcgccatcaatcgccgccgcctcgtcccgcttctcggctgaggcgccgcgcggccaggcagcgggtccaggcctcagccgcgcgcccaggggcctccggggccctcccgggtcagcatgcccggggtgaaactgaccacccaggcctactgcaagatggtgctgcacggcgccaagtacccgcactgcgccgtcaacgggctcctggtggccgagaagcagaagccgcgtaaggagcacctccccctgggcggccccggcgcccaccacaccctcttcgtggactgcatccccctcttccacggcaccctggccctcgcccccatgctggaggtggctctcaccctgattgattcatggtgcaaagatcatagctacgtgattgctggttattatcaagctaatgagcgagtaaaggatgccagtccaaaccaggttgcgagagaaggtggcctcctttactcgctcattagcttcatcgtgccgaat

SEQ ID NO: 286576 - DNA, 915 bp, Homo sapiens
gcagacttgatggctcccggccccccgacccggcccggcctggcggcgccgcaccggccacctcctgtctcacctgccgccactgcccgccgcgaccgccctctacacccggtgtcccgcgaccggaagagagcaaggccgcgccgcggagcaccacgggatcgaggaagactccgcccgcacccggccgcacggaggtcaccgtggagcggaaaagggtagcgctgcgaacgtcgtaaaatgccgggccgggctgctttccggcaggcgttggagaggctgctttccggcggcgccgggcgagaagcgcgactggagtctggggctgcggcttcccagaggcgcgagtcgcttttccaggagccgaggcccaaacggggccgggcctgaagggtcccccgccagcccgcggccgcgccatcaatcgccgccgcctcgtcccgcttctcggctgaggcgccgcgcggccaggcagcgggtccaggcctcagccgcgcgcccaggggcctccggggccctcccgggtcagcatgcccggggtgaaactgaccacccaggcctactgcaagatggtgctgcacggcgccaagtacccgcactgcgccgtcaacgggctcctggtggccgagaagcagaagccgcgtaaggagcacctccccctgggcggccccggcgcccaccacaccctcttcgtggactgcatccccctcttccacggcaccctggccctcgcccccatgctggaggtggctctcaccctgattgattcatggtgcaaagatcatagctacgtgattgctggttattatcaagctaatgagcgagtaaaggatgccaggtacgtggatgcagaaccctctgtgggcgaggaagtgagcacgtgttgggcagaccccgtctctcgtgtgcttttcg

SEQ ID NO: 286577 - DNA, 1416 bp, Homo sapiens
gcagacttgatggctcccggccccccgacccggcccggcctggcggcgccgcaccggccacctcctgtctcacctgccgccactgcccgccgcgaccgccctctacacccggtgtcccgcgaccggaagagagcaaggccgcgccgcggagcaccacgggatcgaggaagactccgcccgcacccggccgcacggaggtcaccgtggagcggaaaagggtagcgctgcgaacgtcgtaaaatgccgggccgggctgctttccggcaggcgttggagaggctgctttccggcggcgccgggcgagaagcgcgactggagtctggggctgcggcttcccagaggcgcgagtcgcttttccaggagccgaggcccaaacggggccgggcctgaagggtcccccgccagcccgcggccgcgccatcaatcgccgccgcctcgtcccgcttctcggctgaggcgccgcgcggccaggcagcgggtccaggcctcagccgcgcgcccaggggcctccggggccctcccgggtcagcatgcccggggtgaaactgaccacccaggcctactgcaagatggtgctgcacggcgccaagtacccgcactgcgccgtcaacgggctcctggtggccgagaagcagaagccgcgtaaggagcacctccccctgggcggccccggcgcccaccacaccctcttcgtggactgcatccccctcttccacggcaccctggccctcgcccccatgctggaggtggctctcaccctgattgattcatggtgcaaagatcatagctacgtgattgctggttattatcaagctaatgagcgagtaaaggatgccagtccaaaccaggttgcagagaaggtggcctccagaatcgccgagggcttcagcgacactgcgctcatcatggtagacaacaccaagtttacgatggactgcgtagcgcctacgatccacgtgtacgagcaccatgagaacagatggcggtgcagagacccacaccatgactactgtgaagactggccagaggcacagaggatctcagcctcgctcctggacagccggtcctacgagacgctcgtggatttcgataaccacctggatgacattcggaatgactggacaaacccagagatcaataaagctgtcctacacttgtgctaggcaggcaccgctgtgactgggctccgggcctttccactacgttgaagaagaaaacctatttttaaatttcaatcaaatgcctggtaggaattgctagcgttgcccctgccaactctcagacggagtctcgcactgtcacccgattggagcacaatgccgcagtctcggttcactgcaacctccgcctgctgggttcaagcgattctcctgcctcagcctcccgagtagctgggattacaggcgcccgccacca

SEQ ID NO: 286578 - DNA, 2145 bp, Homo sapiens
gcagacttgatggctcccggccccccgacccggcccggcctggcggcgccgcaccggccacctcctgtctcacctgccgccactgcccgccgcgaccgccctctacacccggtgtcccgcgaccggaagagagcaaggccgcgccgcggagcaccacgggatcgaggaagactccgcccgcacccggccgcacggaggtcaccgtggagcggaaaagggtagcgctgcgaacgtcgtaaaatgccgggccgggctgctttccggcaggcgttggagaggctgctttccggcggcgccgggcgagaagcgcgactggagtctggggctgcggcttcccagaggcgcgagtcgcttttccaggagccgaggcccaaacggggccgggcctgaagggtcccccgccagcccgcggccgcgccatcaatcgccgccgcctcgtcccgcttctcggctgaggcgccgcgcggccaggcagcgggtccaggcctcagccgcgcgcccaggggcctccggggccctcccgggtcagcatgcccggggtgaaactgaccacccaggcctactgcaagatggtgctgcacggcgccaagtacccgcatgcatccccctcttccacggcaccctggccctcgcccccatgctggaggtggctctcaccctgattgattcatggtgcaaagatcatagctacgtgattgctggttattatcaagctaatgagcgagtaaaggatgccagtccaaaccaggttgcagagaaggtggcctccagaatcgccgagggcttcagcgacactgcgctcatcatggtagacaacaccaagtttacgatggactgcgtagcgcctacgatccacgtgtacgagcaccatgagaacagatggcggtgcagagacccacaccatgactactgtgaagactggccagaggcacagaggatctcagcctcgctcctggacagccggtcctacgagacgctcgtggatttcgataaccacctggatgacattcggaatgactggacaaacccagagatcaataaagctgtcctacacttgtgctaggcaggcaccgctgtgactgggctccgggcctttccactacgttgaagaagaaaacctatttttaaatgtaaataaaatatctggtagcctgtgtggaaagctgaccgttttaagaagtggcatgtgccttgaaagggggcagaatgttcagtcggtcgtgtttttaacacagagtctctagaagaggtgcagacatcccgtctgactgtccctgtggactctctcagttgtatgttgctataatcctccaaatcaaagctctttctgcttgtgcaagattgttcctattaaacagttttaactaaccttttataatctggagagaatactttttaaggcttttgaactatctttttttaaaaaaaaaaaaaagcccacatcttatactccaatgagtgtgtttgtgagtttttatcctgtttgaattttgatgtcgtccaggcgtcctgggatcagggtagacacgtggagtgctggtgctgagctgtttgagaagctctgtgtgggtgtttctgtggtcaggtaggctgggctgtgaacagcactgctccacatggtgtcggctcacagagccaccgcaactctgcccagcgggagtgacaccactgatgccacagaagcctttatcgttaggggcaaaagcagacatctctggtagcaggagctcagtgtggtgctcttcagccacgcagaaagctcacgtgcctgcagggccaggaaagggaaatgatcgtttcttttgtattaggaaaaacaagacttagacttcccgagttgtgcagagtgacgtctgtactttttatacttagaacatttggtcaagttttgtaaccaaaccttagggaattgagagggaaactttatggtacgtttaccttttttcctttttatatgaattattttgtacaaagttcagagagcggtacctttcctactgtcttttctttgactccatggaggaatttgtaacgatcggtgtgacctgaaagggtttgtgatacagcggtcactattttctcttaacacataggaaaaaagttcagacatcgctacaataaatgtgctttatttgatccaccaaa

SEQ ID NO: 286579 - DNA, 2326 bp, Homo sapiens
gcagacttgatggctcccggccccccgacccggcccggcctggcggcgccgcaccggccacctcctgtctcacctgccgccactgcccgccgcgaccgccctctacacccggtgtcccgcgaccggaagagagcaaggccgcgccgcggagcaccacgggatcgaggaagactccgcccgcacccggccgcacggaggtcaccgtggagcggaaaagggtagcgctgcgaacgtcgtaaaatgccgggccgggctgctttccggcaggcgttggagaggctgctttccggcggcgccgggcgagaagcgcgactggagtctggggctgcggcttcccagaggcgcgagtcgcttttccaggagccgaggcccaaacggggccgggcctgaagggtcccccgccagcccgcggccgcgccatcaatcgccgccgcctcgtcccgcttctcggctgaggcgccgcgcggccaggcagcgggtccaggcctcagccgcgcgcccaggggcctccggggccctcccgggtcagcatgcccggggtgaaactgaccacccaggcctactgcaagatggtgctgcacggcgccaagtacccgcactgcgccgtcaacgggctcctggtggccgagaagcagaagccgcgtaaggagcacctccccctgggcggccccggcgcccaccacaccctcttcgtggactgcatccccctcttccacggcaccctggccctcgcccccatgctggaggtggctctcaccctgatggagtttcgctcttgtcacccagcctggagtgcagtggcgtgatctcggctcgctgcaacttccgcctcccggattcagattgattcatggtgcaaagatcatagctacgtgattgctggttattatcaagctaatgagcgagtaaaggatgccagtccaaaccaggttgcagagaaggtggcctccagaatcgccgagggcttcagcgacactgcgctcatcatggtagacaacaccaagtttacgatggactgcgtagcgcctacgatccacgtgtacgagcaccatgagaacagatggcggtgcagagacccacaccatgactactgtgaagactggccagaggcacagaggatctcagcctcgctcctggacagccggtcctacgagacgctcgtggatttcgataaccacctggatgacattcggaatgactggacaaacccagagatcaataaagctgtcctacacttgtgctaggcaggcaccgctgtgactgggctccgggcctttccactacgttgaagaagaaaacctatttttaaatgtaaataaaatatctggtagcctgtgtggaaagctgaccgttttaagaagtggcatgtgccttgaaagggggcagaatgttcagtcggtcgtgtttttaacacagagtctctagaagaggtgcagacatcccgtctgactgtccctgtggactctctcagttgtatgttgctataatcctccaaatcaaagctctttctgcttgtgcaagattgttcctattaaacagttttaactaaccttttataatctggagagaatactttttaaggcttttgaactatctttttttaaaaaaaaaaaaaagcccacatcttatactccaatgagtgtgtttgtgagtttttatcctgtttgaattttgatgtcgtccaggcgtcctgggatcagggtagacacgtggagtgctggtgctgagctgtttgagaagctctgtgtgggtgtttctgtggtcaggtaggctgggctgtgaacagcactgctccacatggtgtcggctcacagagccaccgcaactctgcccagcgggagtgacaccactgatgccacagaagcctttatcgttaggggcaaaagcagacatctctggtagcaggagctcagtgtggtgctcttcagccacgcagaaagctcacgtgcctgcagggccaggaaagggaaatgatcgtttcttttgtattaggaaaaacaagacttagacttcccgagttgtgcagagtgacgtctgtactttttatacttagaacatttggtcaagttttgtaaccaaaccttagggaattgagagggaaactttatggtacgtttaccttttttcctttttatatgaattattttgtacaaagttcagagagcggtacctttcctactgtcttttctttgactccatggaggaatttgtaacgatcggtgtgacctgaaagggtttgtgatacagcggtcactattttctcttaacacataggaaaaaagttcagacatcgctacaataaatgtgctttatttgatccaccaaa

SEQ ID NO: 286580 - DNA, 1352 bp, Homo sapiens
gcagacttgatggctcccggccccccgacccggcccggcctggcggcgccgcaccggccacctcctgtctcacctgccgccactgcccgccgcgaccgccctctacacccggtgtcccgcgaccggaagagagcaaggccgcgccgcggagcaccacgggatcgaggaagactccgcccgcacccggccgcacggaggtcaccgtggagcggaaaagggtagcgctgcgaacgtcgtaaaatgccgggccgggctgctttccggcaggcgttggagaggctgctttccggcggcgccgggcgagaagcgcgactggagtctggggctgcggcttcccagaggcgcgagtcgcttttccaggagccgaggcccaaacggggccgggcctgaagggtcccccgccagcccgcggccgcgccatcaatcgccgccgcctcgtcccgcttctcggctgaggcgccgcgcggccaggcagcgggtccaggcctcagccgcgcgcccaggggcctccggggccctcccgggtcagcatgcccggggtgaaactgaccacccaggcctactgcaagatggtgctgcacggcgccaagtacccgcactgcgccgtcaacgggctcctggtggccgagaagcagaagccgcgtaaggagcacctccccctgggcggccccggcgcccaccacaccctcttcgtggactgcatccccctcttccacggcaccctggccctcgcccccatgctggaggtggctctcaccctgattgattcatggtgcaaagatcatagctacgtgattgctggttattatcaagctaatgagcgagtaaaggatgccagtccaaaccaggttgcagagaaggtggcctccagaatcgccgagggcttcagcgacactgcgctcatcatggtaagtcgcttctgtgcagcatgtgggaggcccttgcgcctcctctcaccaacctggagcttgctctgcggcggtttcctttccgctaaccccttcactcatttatctgcttgagaccattgccgcctcttgcagttttctctcagctgcagaccagttgaatcccaggccatggcttctgtgcttccgcatcactacacaagtgggagtggggtcccctgccagccgcagcacctgggaacttgttagaaatgcgaattcccaggcacccaccccagaccccactgaatcagaaatgcgggggtttagcccagcagtccatgttaagacaccttctagatgattctggtctgaacatgccaagtgtgagaagcacaattagaacagccagcacagcctctaggggcacagggaaggaaggtccttgtatgtgagcagatgaca

SEQ ID NO: 286581 - DNA, 5041 bp, Homo sapiens
cgggctccggctgccatggaggaggaagaggaggcgataggcttgctggacaaggttctggaggacgaagatgtgtttctcctggaggagtgcgagctgggaaccccgaccagccccggctcagggtcccccttcctggtggctgtgaaggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaa

SEQ ID NO: 286582 - DNA, 798 bp, Homo sapiens
cgggctccggctgccatggaggaggaagaggaggcgataggcttgctggacaaggttctggaggacgaagatgtgtttctcctggaggagtgcgagctgggaaccccgaccagccccggctcagggtcccccttcctggtggctgtgaagggtgcggtggctcacacctgtaatcccagcactttgggaggccgaggcgggcggatcacgaggtcaggagatcgagaccatcctggctaacacggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgactgttgaagcacaacctttggccacccgattaccgctgtgcaggt

SEQ ID NO: 286583 - DNA, 451 bp, Homo sapiens
tttttttttaacaatcccttggggcaattgtccgggtcaaaactttagggagatttttttttaaatggggggtaaccccggggggggaaaatgttaataaaaaatgcaaagccccatcatttgcacaaaactcagccctgtggtgtggatgtttgtgttcgcggtggtccagggaagccaccaatgtaaatatttaactcttccagctgcatccagatgtgagtttccaggaatctgtttacctagttcactccccttgagcctccctgtggcccacgggggctggggcagagctgcggggaggtgggctggagccctctccttgctcttcacaaaggcctccggatcagccagcatccaggctgcttctggctcacctttgccatgtgctgctacagtacaaatgtcccacctggccatcggtgtgccttgaaagtggcatgaagttgtc

SEQ ID NO: 286584 - DNA, 5207 bp, Homo sapiens
gcggccgcagcgggggacccgcgacctggagcagcgggaggccgaggccaagggccgcccgggctcgcccctcgccgcggaggagacccccgggcgcgagcacctgcccccgtggcggcgccgcaggttcctgcgggtgcccgagcgggactcgcccggccacagctcgccggagagagacagcgacggcagccggcacagctccgaccgcgaggacgacttctccgcagacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctgggcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaa

SEQ ID NO: 286585 - DNA, 4820 bp, Homo sapiens
aaagattaattaacagtggagcctgtgtcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaa

SEQ ID NO: 286586 - DNA, 5257 bp, Homo sapiens
gcggccgcagcgggggacccgcgacctggagcagcgggaggccgaggccaagggccgcccgggctcgcccctcgccgcggaggagacccccgggcgcgagcacctgcccccgtggcggcgccgcaggttcctgcgggtgcccgagcgggactcgcccggccacagctcgccggagagagacagcgacggcagccggcacagctccgaccgcgaggacgacttctccgcagacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaa

SEQ ID NO: 286587 - DNA, 3412 bp, Homo sapiens
taagaccctcatcaatagatggagacatacagaaatagtcaaaccacatctacaaaatgccagtatcaggcggcggcttcgaagccaaagtgatgtttggatgtaaagtgaaatattagttggcggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaa

SEQ ID NO: 286588 - DNA, 3097 bp, Homo sapiens
gcaggtaagcaactgcagaaactcacaagggccgactcacttgcccaggatgacccaacttataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaa

SEQ ID NO: 286589 - DNA, 2433 bp, Homo sapiens
tcgaatcgagctcggtaccgattacgctcctagacggcttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaa

SEQ ID NO: 286590 - DNA, 3026 bp, Homo sapiens
  misc_feature (33)..(33): n is a, c, g, or t
  misc_feature (42)..(43): n is a, c, g, or t
  misc_feature (100)..(100): n is a, c, g, or t
  misc_feature (108)..(108): n is a, c, g, or t
  misc_feature (114)..(114): n is a, c, g, or t
agctgcacaggtgcgagctgccggcgttgtacnaggtgaaanngacgtagcattccagttcttggaagctggcttccctcgagtctggagtgctgggttngggagttntctatngagtctttcaagtctgagttggaccccaggctggagggactggttccgccacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaa

SEQ ID NO: 286591 - DNA, 2856 bp, Homo sapiens
  misc_feature (33)..(33): n is a, c, g, or t
  misc_feature (42)..(43): n is a, c, g, or t
  misc_feature (100)..(100): n is a, c, g, or t
  misc_feature (108)..(108): n is a, c, g, or t
  misc_feature (114)..(114): n is a, c, g, or t
agctgcacaggtgcgagctgccggcgttgtacnaggtgaaanngacgtagcattccagttcttggaagctggcttccctcgagtctggagtgctgggttngggagttntctatngagtctttcaagtctgagttggaccccaggctggagtcagcaaggacgaggccaaggacagggagcccagcctccgccttcctgtctccccacaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaa

SEQ ID NO: 286592 - DNA, 5627 bp, Homo sapiens
gcggccgcagcgggggacccgcgacctggagcagcgggaggccgaggccaagggccgcccgggctcgcccctcgccgcggaggagacccccgggcgcgagcacctgcccccgtggcggcgccgcaggttcctgcgggtgcccgagcgggactcgcccggccacagctcgccggagagagacagcgacggcagccggcacagctccgaccgcgaggacgacttctccgcagacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaactcagccctgtggtgtggatgtttgtgttcgcggtggtccagggaagccaccaatgtaaatatttaactcttccagctgcatccagatgtgagtttccaggaatctgtttacctagttcactccccttgagcctccctgtggcccacgggggctggggcagagctgcggggaggtgggctggagccctctccttgctcttcacaaaggcctccggatcagccagcatccaggctgcttctggctcacctttgccatgtgctgctacagtacaaatgtcccacctggccatcggtgtgccttgaaagtggcatgaagttgtc

SEQ ID NO: 286593 - DNA, 5250 bp, Homo sapiens
gcggccgcagcgggggacccgcgacctggagcagcgggaggccgaggccaagggccgcccgggctcgcccctcgccgcggaggagacccccgggcgcgagcacctgcccccgtggcggcgccgcaggttcctgcgggtgcccgagcgggactcgcccggccacagctcgccggagagagacagcgacggcagccggcacagctccgaccgcgaggacgacttctccgcagacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaa

SEQ ID NO: 286594 - DNA, 1205 bp, Homo sapiens
gacccacgcgtcggacgcgtgggtcgacccacgcgtcgcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaa

SEQ ID NO: 286595 - DNA, 3394 bp, Homo sapiens
gcggccgcagcgggggacccgcgacctggagcagcgggaggccgaggccaagggccgcccgggctcgcccctcgccgcggaggagacccccgggcgcgagcacctgcccccgtggcggcgccgcaggttcctgcgggtgcccgagcgggactcgcccggccacagctcgccggagagagacagcgacggcagccggcacagctccgaccgcgaggacgacttctccgcagacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccattgcgcaattcacgcctggggggccaagagtgagactttgtttcacaaaaaaaaaaaatataaaagaattattggaaaacaggacttgccttcatgcttctgtcagtgtac

SEQ ID NO: 286596 - DNA, 2738 bp, Homo sapiens
  misc_feature (2729)..(2729): n is a, c, g, or t
  misc_feature (2737)..(2738): n is a, c, g, or t
gcggccgcagcgggggacccgcgacctggagcagcgggaggccgaggccaagggccgcccgggctcgcccctcgccgcggaggagacccccgggcgcgagcacctgcccccgtggcggcgccgcaggttcctgcgggtgcccgagcgggactcgcccggccacagctcgccggagagagacagcgacggcagccggcacagctccgaccgcgaggacgacttctccgcagacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcagccaggtcctcctctactacccacagccaccatcaccaaaactgggcccagcctaaatgcgtcaatagcanctgctgcnn

SEQ ID NO: 286597 - DNA, 373 bp, Homo sapiens
caggtggctcataaaggatatggtgggccccatgtcccagtctagggccgaatctttacttgttttttaaatgtctttccggcagggtgcggtggctcacacctgtaatcccagcactttgggaggccgaggcgggcggatcacgaggtcaggagatcgagaccatcctggctaacacggtgaaatcccggctctactaaaaatacaaaaagttagctgggcgtggtggcgggagcctgtagtcccagctactcgggaggctgaggcaggagaatggcgtgaacccgggaggcggagcttgcagtgagccgagatcgcgccactgcactctagcctgggcgacagagcgagactccgtctctaaaaaaaaaaa

SEQ ID NO: 286598 - DNA, 620 bp, Homo sapiens
gagagctgtcgtgggggctgccctccacccatcctcacgctccaccccaggcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccagtgagtctgggaggcccagccggggcaggtgtggctgtgtctgagcaggctggtgggatggacaggagagctcgggggaaccaggagcctccctggagaggaggcttgctctgcttcagagtccccgtggcaagtgctttctcttgtaatcccctcccctccaatctcttgtcccttgctgcaggtaagcaactgcagaaactcacaagggccgactcacttgcccaggatgacccaacttgtaggttttggttctggacttaaaactcagatctgactccagtgtctttcttgctagttcctgggtgcctggtgagccgcagggaaagagctttgagcctgcacctgctgtctccagggccccaggtcccctctggggcagtgctgcctctgcgtgaagcccaccatggtgaggcctgacctttctggt

SEQ ID NO: 286599 - DNA, 5247 bp, Homo sapiens
ctcgcccctccgcgctcgcaacttcggcctcccccggctcccgcccgccctccctcctttgttgcgcgatgagggtcgggtttcggatctgaccgagccgccgccgcgggatggagccgctcagccaccggggcctgccgcgcctgtcctggatcgacaccctctacagcaacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaa

SEQ ID NO: 286600 - DNA, 576 bp, Homo sapiens
gcggccgcagcgggggacccgcgacctggagcagcgggaggccgaggccaagggccgcccgggctcgcccctcgccgcggaggagacccccgggcgcgagcacctgcccccgtggcggcgccgcaggttcctgcgggtgcccgagcgggactcgcccggccacagctcgccggagagagacagcgacggcagccggcacagctccgaccgcgaggacgacttctccgcagacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaagcacgcagcactccagccgtgtacatcagcaatgaacattctaca

SEQ ID NO: 286601 - DNA, 5306 bp, Homo sapiens
gcggccgcagcgggggacccgcgacctggagcagcgggaggccgaggccaagggccgcccgggctcgcccctcgccgcggaggagacccccgggcgcgagcacctgcccccgtggcggcgccgcaggttcctgcgggtgcccgagcgggactcgcccggccacagctcgccggagagagacagcgacggcagccggcacagctccgaccgcgaggacgacttctccgcagacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaa

SEQ ID NO: 286602 - DNA, 5135 bp, Homo sapiens
cgggctccggctgccatggaggaggaagaggaggcgataggcttgctggacaaggttctggaggacgaagatgtgtttctcctggaggagtgcgagctgggaaccccgaccagccccggctcagggtcccccttcctggtggctgtgaagggtgcggtggctcacacctgtaatcccagcactttgggaggccgaggcgggcggatcacgaggtcaggagatcgagaccatcctggctaacacggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaa

SEQ ID NO: 286603 - DNA, 4627 bp, Homo sapiens
ctggaagagcactccggagcggctgcccgatgctggagtccgtgcggcagcatcagcaaggtggctgagtggccgggctgctggtgggcgccggggagcctggagcgatggctgcacgctcccgccgcggggacagaggctgccatggagattctcctcattattcgcttctgctgtaactgcacctatgctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaa

SEQ ID NO: 286604 - DNA, 3212 bp, Homo sapiens
cctggagtggaggacggggtggggcctgggaactggccggcgttggtgcctctgtgcagcctagaagctgaggctttgtcggaacatgcttttacgtgtgaaaagtgtgcaatgccttccagagaggggcttagcgatggagaggttccagtcggaaggaagctgcaggccacatgataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaa

SEQ ID NO: 286605 - DNA, 3134 bp, Homo sapiens
tcgctgatgatggtcaaggctgtttccggggagtaaaacatctacaggatatccggcgttctcctgagggcaggcgctcaaggccaacttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaa

SEQ ID NO: 286606 - DNA, 6107 bp, Homo sapiens
gcggccgcagcgggggacccgcgacctggagcagcgggaggccgaggccaagggccgcccgggctcgcccctcgccgcggaggagacccccgggcgcgagcacctgcccccgtggcggcgccgcaggttcctgcgggtgcccgagcgggactcgcccggccacagctcgccggagagagacagcgacggcagccggcacagctccgaccgcgaggacgacttctccgcagacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaaaaaaaaaaaaacaaacacacaaaccaaaaaaaaaaaaaaaaaaaaaaaaacacaaataacaaacaaacaaacaaaaacaaaaccaaaaacacaaaaaaaaaaaaacaagaaaaaaagaaaccaaaataaaagaacaaaagggggagggaggcggcgagcacgaaaaaaaggctcagacaagaggggaaagacaacccacaagcgcgcccacgcagaaacgaggggagacagcgcagcgcgcagccgccagcgcgcagccataagcaagacgcagcggcaaggagaaccggaaaactcacggggagacgggagagagacacgcagagtcgagcgtgaaaaggcatgaagaaagaagctataagcgcggggcgggataagaagcagaagaaacacacgagacagcgagaacagggggccgggaaaaggaagaaaagactaggggagaggcacagaaggatccgacagaaaggcgcggttagcctgaagggagagccgggcagagcaatcgcgaaggtattatactaacaaaagtacacgggtggggtgcgagagcaagaaggaggacgacgcgcgaggagcggcgtcggggtatgcatcgggagtcagtggccgcttggtgaaggatgaggccctgcggggggtggcggtgaagaggtaacgtgggagaacggacgatacatgggggacgaacgaaccgttagtgcggagtgggctggggacggagaagaggggaggagcaagcaacggacgaagcgcggagacggcaggtcggccaggagcagtaagagcgtagtgggtaga

SEQ ID NO: 286607 - DNA, 5227 bp, Homo sapiens
gcggccgcagcgggggacccgcgacctggagcagcgggaggccgaggccaagggccgcccgggctcgcccctcgccgcggaggagacccccgggcgcgagcacctgcccccgtggcggcgccgcaggttcctgcgggtgcccgagcgggactcgcccggccacagctcgccggagagagacagcgacggcagccggcacagctccgaccgcgaggacgacttctccgcagacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcacgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatgtcgcatttccgtgaattttgtagtagtag

SEQ ID NO: 286608 - DNA, 3968 bp, Homo sapiens
gcggccgcagcgggggacccgcgacctggagcagcgggaggccgaggccaagggccgcccgggctcgcccctcgccgcggaggagacccccgggcgcgagcacctgcccccgtggcggcgccgcaggttcctgcgggtgcccgagcgggactcgcccggccacagctcgccggagagagacagcgacggcagccggcacagctccgaccgcgaggacgacttctccgcagacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactctacacccagatcacacaaatagcacgcaccccactcattcccgactcccgctcatagctg

SEQ ID NO: 286609 - DNA, 3048 bp, Homo sapiens
gcggccgcagcgggggacccgcgacctggagcagcgggaggccgaggccaagggccgcccgggctcgcccctcgccgcggaggagacccccgggcgcgagcacctgcccccgtggcggcgccgcaggttcctgcgggtgcccgagcgggactcgcccggccacagctcgccggagagagacagcgacggcagccggcacagctccgaccgcgaggacgacttctccgcagacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaatcggggactgtcgggctatcggcaacggatcctctaga

SEQ ID NO: 286610 - DNA, 2034 bp, Homo sapiens
gcggccgcagcgggggacccgcgacctggagcagcgggaggccgaggccaagggccgcccgggctcgcccctcgccgcggaggagacccccgggcgcgagcacctgcccccgtggcggcgccgcaggttcctgcgggtgcccgagcgggactcgcccggccacagctcgccggagagagacagcgacggcagccggcacagctccgaccgcgaggacgacttctccgcagacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccaggtgaggccagggcgccggggcgaggctgagggagcctccaggaggtggttccagttgaaaaggaattctggtca

SEQ ID NO: 286611 - DNA, 319 bp, Homo sapiens
ggggctcccgccccgccctcgcccctgccccggccgccccgcgctcctcccggggacctggttcccggcctcctcgcccctccgcgctcgcaacttcggcctcccccggctcccgcccgccctccctcctttgttgcgcgatgagggtcgggtttcggatctgaccgagccgccgccgcgggatggagccgctcagccaccggggcctgccgcgcctgtcctggatcgacaccctctacagcagtacgtgtgccgggcgggggcgggaccccaggatcgggatcgggaccccaggatggagatcgggaccccaggatcg

SEQ ID NO: 286612 - DNA, 3121 bp, Homo sapiens
gagcaagccgagtggagggaggcaaaggccaggctgaggatcagggtggcccgggtggcagcggggaggcgctgcatgctggaggctgtgctgagtgcccggtgcaggtgagccggtcctgcggagttgtgccgagtgcctgctgcagtctcatttccagttcctccatgacgtggcaagtgaagacaggaatgaaaggaatgtaaagcagcttttctctgaagagaagaagagagagagacacagccaagaccgaggctgggccaagatggcgtctgtgtttcgaagcgaggagatgtgtttgtcacaactgtttctccaggtggaagctgcatattgctgtgtggctgagctcggagagctcggattggttcagttcaaagatttaaatatgaatgtgaacagctttcaaaggaaatttgtgaatgaagtcagaaggtgtgaatcactggagagaatcctccgttttctggaagacgagatgcaaaatgagattgtagttcagttgctcgagaaaagcccactgaccccgctcccacgggaaatgattaccctggagactgttctagaaaaactggaaggagagttacaggaagccaaccagaaccagcaggccttgaaacaaagcttcctagaactgacagaactgaaatacctcctgaagaaaacccaagacttctttgagacggaaaccaatttagctgatgatttctttactgaggacacttctggcctcctggagttgaaagcagtgcctgcatatatgaccggaaagttggggttcatagccggtgtgatcaacagggagaggatggcttcctttgagcggttactgtggcgaatctgccgaggaaacgtgtacttgaagttcagtgagatggacgcccctctggaggatcctgtgacgaaagaagaaattcagaagaacatattcatcatattttaccaaggagagcagctcaggcagaaaatcaagaagatctgtgatgggtttcgagccactgtctacccttgcccagagcctgcggtggagcgcagagagatgttggagagcgtcaatgtgaggctggaagatttaatcaccgtcataacacaaacagagtctcaccgccagcgcctgctgcaggaagccgctgccaactggcactcctggctcatcaaggtgcagaagatgaaagctgtctaccacatcctgaacatgtgcaacatcgacgtcacccagcagtgtgtcatcgccgagatctggttcccggtggcagatgccacacgtatcaagagggcactggagcaaggcatggaactaagtggctcctccatggcccccatcatgaccacagtgcaatctaaaacagcccctcccacatttaacaggaccaataaattcacagctggcttccagaatattgttgatgcctatggtgtcggcagctaccgggagataaacccagccccctacaccatcatcactttccccttcctgttcgctgtgatgtttggagactgtggtcatggaaccgtgatgctcctggctgcactttggatgattctgaatgagagacgcttgctctcccagaagacagacaatgagatttggaacaccttcttccacgggcgctatctgatcctacttatgggcatcttctccatctacacgggtttgatctacaatgactgcttctccaagtccttgaacatctttggctcttcttggagtgtccaacccatgttcagaaacggcacatggaatactcatgtaatggaggaaagtctatatctgcagctggacccagccataccaggagtgtattttggaaatccatacccgtttgggattgatccgatttggaacttggcttcaaacaaactcacatttctgaactcgtataaaatgaagatgtcggtgatcctgggaattgtccagatggtttttggtgtcatcctcagccttttcaatcacatatacttcagaagaactctcaacatcattctgcaatttatccctgagatgatttttatcctgtgtctgtttggatacctggttttcatgatcattttcaaatggtgctgctttgacgtccacgtatctcagcacgcccccagcatcctcatccacttcatcaacatgtttctgtttaactacagtgactcttccaacgcacccctctacaaacatcagcaagaagtccaaagtttctttgtggttatggctttgatttctgtgccgtggatgcttctgattaagccgtttattcttagagccagtcatcggaaatcccagctgcaggcatccaggatccaagaagatgccactgagaacattgaaggtgatagctccagcccttctagccgttctggccagaggacttctgcagatacccacggggctctggacgaccatggagaagagttcaactttggagacgtctttgtccaccaagccatccacaccatcgagtactgcctgggctgcatttcaaacacagcctcctacctgcggctctgggccctcagcctggctcatgcacaactgtctgaagtgctctggactatggtgatgaacagcggccttcagacgcgaggctggggaggaatcgtcggggtttttattatttttgccgtatttgctgtcctgacagtagccatccttctgatcatggagggcctctctgctttcctgcacgccctgcgactgcactgggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggttgttcttggctcacctgaagcatgaaactgtgtattatttggacgtcagcctgtggatttgatacgacttaaccacgtcagaggaaggactttggcaagtgatattgtcttcatgtggggtattaattctcaaataataaagtaattgacaaatgaggggagaatgctaaacagatgtcttcttgcaatattttaaatattgtatttgagaaaataaacatctgagtcattca

SEQ ID NO: 286613 - DNA, 2033 bp, Homo sapiens
ctgggactccttttccagtggccaaagacgcagttattctaggataggctggccatctaactaaagtcagcaaacgatgtcttagcagaaaaggggatgcagaatgctttgcagcaagaactcacctgtttcctttggaatatattaaacacaggtttcgagccactgtctacccttgcccagagcctgcggtggagcgcagagagatgttggagagcgtcaatgtgaggctggaagatttaatcaccgtcataacacaaacagagtctcaccgccagcgcctgctgcaggaagccgctgccaactggcactcctggctcatcaaggtgcagaagatgaaagctgtctaccacatcctgaacatgtgcaacatcgacgtcacccagcagtgtgtcatcgccgagatctggttcccggtggcagatgccacacgtatcaagagggcactggagcaaggcatggaactaagtggctcctccatggcccccatcatgaccacagtgcaatctaaaacagcccctcccacatttaacaggaccaataaattcacagctggcttccagaatattgttgatgcctatggtgtcggcagctaccgggagataaacccagccccctacaccatcatcactttccccttcctgttcgctgtgatgtttggagactgtggtcatggaaccgtgatgctcctggctgcactttggatgattctgaatgagagacgcttgctctcccagaagacagacaatgagatttggaacttggcttcaaacaaactcacatttctgaactcgtataaaatgaagatgtcggtgatcctgggaattgtccagatggtttttggtgtcatcctcagccttttcaatcacatatacttcagaagaactctcaacatcattctgcaatttatccctgagatgatttttatcctgtgtctgtttggatacctggttttcatgatcattttcaaatggtgctgctttgacgtccacgtatctcagcacgcccccagcatcctcatccacttcatcaacatgtttctgtttaactacagtgactcttccaacgcacccctctacaaacatcagcaagaagtccaaagtttctttgtggttatggctttgatttctgtgccgtggatgcttctgattaagccgtttattcttagagccagtcatcggaaatcccagctgcaggcatccaggatccaagaagatgccactgagaacattgaaggtgatagctccagcccttctagccgttctggccagaggacttctgcagatacccacggggctctggacgaccatggagaagagttcaactttggagacgtctttgtccaccaagccatccacaccatcgagtactgcctgggctgcatttcaaacacagcctcctacctgcggctctgggccctcagcctggctcatgcacaactgtctgaagtgctctggactatggtgatgaacagcggccttcagacgcgaggctggggaggaatcgtcggggtttttattatttttgccgtatttgctgtcctgacagtagccatccttctgatcatggagggcctctctgctttcctgcacgccctgcgactgcactgggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggttgttcttggctcacctgaagcatgaaactgtgtattatttggacgtcagcctgtggatttgatacgacttaaccacgtcagaggaaggactttggcaagtgatattgtcttcatgtggggtattaattctcaaataataaagtaattgacaaatgaggggagaatgctaaacagatgtcttcttgcaatattttaaatattgtatttgagaaaataaacatctgagtcattca

SEQ ID NO: 286614 - DNA, 1094 bp, Homo sapiens
ctgggactccttttccagtggccaaagacgcagttattctaggataggctggccatctaactaaagtcagcaaacgatgtcttagcagaaaaggggatgcagaatgctttgcagcaagaactcacctgtttcctttggaatatattaaacacaggtttcgagccactgtctacccttgcccagagcctgcggtggagcgcagagagatgttggagagcgtcaatgtgaggctggaagatttaatcaccgtcataacacaaacagagtctcaccgccagcgcctgctgcaggaagccgctgccaactggcactcctggctcatcaaggtgcagaagatgaaagctgtctaccacatcctgaacatgtgcaacatcgacgtcacccagcagtgtgtcatcgccgagatctggttcccggtggcagatgccacacgtatcaagagggcactggagcaaggcatggaactaagtggctcctccatggcccccatcatgaccacagtgcaatctaaaacagcccctcccacatttaacaggaccaataaattcacagctggcttccagaatattgttgatgcctatggtgtcggcagctaccgggagataaacccagccatccttctgatcatggagggcctctctgctttcctgcacgccctgcgactgcactgggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggttgttcttggctcacctgaagcatgaaactgtgtattatttggacgtcagcctgtggatttgatacgacttaaccacgtcagaggaaggactttggcaagtgatattgtcttcatgtggggtattaattctcaaataataaagtaattgacaaatgaggggagaatgctaaacagatgtcttcttgcaatattttaaatattgtatttgagaaaataaacatctgagtcattca

SEQ ID NO: 286615 - DNA, 320 bp, Homo sapiens
ttctgcagatacccacggggctctggacgaccatggagaagaggtatctgggacgagagcccctgaggaagactccccagtttgtacaaattctagaatggacataggcagtagagctgggtgggtctggagggccccacggggcagtagccctgtcactgctgagtcctgggaagctgtgaaggtctcagggaaggggacctactagctagtctaagaggatcagaacagctatttagcaaccaatctgggcacattttaatatttctagtccaagtaccgctgcatctgtatgtgtcaggtgaatatcagcctcggat

SEQ ID NO: 286616 - DNA, 2285 bp, Homo sapiens
ctgggactccttttccagtggccaaagacgcagttattctaggataggctggccatctaactaaagtcagcaaacgatgtcttagcagaaaaggggatgcagaatgctttgcagcaagaactcacctgtttcctttggaatatattaaacacaggtttcgagccactgtctacccttgcccagagcctgcggtggagcgcagagagatgttggagagcgtcaatgtgaggctggaagatttaatcaccgtcataacacaaacagagtctcaccgccagcgcctgctgcaggaagccgctgccaactggcactcctggctcatcaaggtgcagaagatgaaagctgtctaccacatcctgaacatgtgcaacatcgacgtcacccagcagtgtgtcatcgccgagatctggttcccggtggcagatgccacacgtatcaagagggcactggagcaaggcatggaactaagtggctcctccatggcccccatcatgaccacagtgcaatctaaaacagcccctcccacatttaacaggaccaataaattcacagctggcttccagaatattgttgatgcctatggtgtcggcagctaccgggagataaacccagccccctacaccatcatcactttccccttcctgttcgctgtgatgtttggagactgtggtcatggaaccgtgatgctcctggctgcactttggatgattctgaatgagagacgcttgctctcccagaagacagacaatgagatttggaacaccttcttccacgggcgctatctgatcctacttatgggcatcttctccatctacacgggtttgatctacaatgactgcttctccaagtccttgaacatctttggctcttcttggagtgtccaacccatgttcagaaacggcacatggaatactcatgtaatggaggaaagtctatatctgcagctggacccagccataccaggagtgtattttggaaatccatacccgtttgggattgatccgatttggaacttggcttcaaacaaactcacatttctgaactcgtataaaatgaagatgtcggtgatcctgggaattgtccagatggtttttggtgtcatcctcagccttttcaatcacatatacttcagaagaactctcaacatcattctgcaatttatccctgagatgatttttatcctgtgtctgtttggatacctggttttcatgatcattttcaaatggtgctgctttgacgtccacgtatctcagcacgcccccagcatcctcatccacttcatcaacatgtttctgtttaactacagtgactcttccaacgcacccctctacaaacatcagcaagaagtccaaagtttctttgtggttatggctttgatttctgtgccgtggatgcttctgattaagccgtttattcttagagccagtcatcggaaatcccagctgcaggcatccaggatccaagaagatgccactgagaacattgaaggtgatagctccagcccttctagccgttctggccagaggacttctgcagatacccacggggctctggacgaccatggagaagagttcaactttggagacgtctttgtccaccaagccatccacaccatcgagtactgcctgggctgcatttcaaacacagcctcctacctgcggctctgggccctcagcctggctcatgcacaactgtctgaagtgctctggactatggtgatgaacagcggccttcagacgcgaggctggggaggaatcgtcggggtttttattatttttgccgtatttgctgtcctgacagtagccatccttctgatcatggagggcctctctgctttcctgcacgccctgcgactgcactgggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggttgttcttggctcacctgaagcatgaaactgtgtattatttggacgtcagcctgtggatttgatacgacttaaccacgtcagaggaaggactttggcaagtgatattgtcttcatgtggggtattaattctcaaataataaagtaattgacaaatgaggggagaatgctaaacagatgtcttcttgcaatattttaaatattgtatttgagaaaataaacatctgagtcattca

SEQ ID NO: 286617 - DNA, 1532 bp, Homo sapiens
gaaaggcttaaggaaacccgcatgcaaatcgtggagctgtggcagggaatctgaggtgggggccccgaggctgtgctgaggcctcaggcgttgtgtgtctcccctccgcagccccctacaccatcatcactttccccttcctgttcgctgtgatgtttggagactgtggtcatggaaccgtgatgctcctggctgcactttggatgattctgaatgagagacgcttgctctcccagaagacagacaatgagatttggaacttggcttcaaacaaactcacatttctgaactcgtataaaatgaagatgtcggtgatcctgggaattgtccagatggtttttggtgtcatcctcagccttttcaatcacatatacttcagaagaactctcaacatcattctgcaatttatccctgagatgatttttatcctgtgtctgtttggatacctggttttcatgatcattttcaaatggtgctgctttgacgtccacgtatctcagcacgcccccagcatcctcatccacttcatcaacatgtttctgtttaactacagtgactcttccaacgcacccctctacaaacatcagcaagaagtccaaagtttctttgtggttatggctttgatttctgtgccgtggatgcttctgattaagccgtttattcttagagccagtcatcggaaatcccagctgcaggcatccaggatccaagaagatgccactgagaacattgaaggtgatagctccagcccttctagccgttctggccagaggacttctgcagatacccacggggctctggacgaccatggagaagagttcaactttggagacgtctttgtccaccaagccatccacaccatcgagtactgcctgggctgcatttcaaacacagcctcctacctgcggctctgggccctcagcctggctcatgcacaactgtctgaagtgctctggactatggtgatgaacagcggccttcagacgcgaggctggggaggaatcgtcggggtttttattatttttgccgtatttgctgtcctgacagtagccatccttctgatcatggagggcctctctgctttcctgcacgccctgcgactgcactgggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggttgttcttggctcacctgaagcatgaaactgtgtattatttggacgtcagcctgtggatttgatacgacttaaccacgtcagaggaaggactttggcaagtgatattgtcttcatgtggggtattaattctcaaataataaagtaattgacaaatgaggggagaatgctaaacagatgtcttcttgcaatattttaaatattgtatttgagaaaataaacatctgagtcattca

SEQ ID NO: 286618 - DNA, 2247 bp, Homo sapiens
ctgggactccttttccagtggccaaagacgcagttattctaggataggctggccatctaactaaagtcagcaaacgatgtcttagcagaaaaggggatgcagaatgctttgcagcaagaactcacctgtttcctttggaatatattaaacacaggtttcgagccactgtctacccttgcccagagcctgcggtggagcgcagagagatgttggagagcgtcaatgtgaggctggaagatttaatcaccgtcataacacaaacagagtctcaccgccagcgcctgctgcaggaagccgctgccaactggcactcctggctcatcaaggtgcagaagatgaaagctgtctaccacatcctgaacatgtgcaacatcgacgtcacccagcagtgtgtcatcgccgagatctggttcccggtggcagatgccacacgtatcaagagggcactggagcaaggcatggaactaagtggctcctccatggcccccatcatgaccacagtgcaatctaaaacagcccctcccacatttaacaggaccaataaattcacagctggcttccagaatattgttgatgcctatggtgtcggcagctaccgggagataaacccagccccctacaccatcatcactttccccttcctgttcgctgtgatgtttggagactgtggtcatggaaccgtgatgctcctggctgcactttggatgattctgaatgagagacgcttgctctcccagaagacagacaatgagatttggaacaccttcttccacgggcgctatctgatcctacttatgggcatcttctccatctacacgggtttgatctacaatgactgcttctccaagtccttgaacatctttggctcttcttggagtgtccaacccatgttcagaaacggcacatggaatactcatgtaatggaggaaagtctatatctgcagctggacccagccataccaggagtgtattttggaaatccatacccgtttgggattgatccgatttggaacttggcttcaaacaaactcacatttctgaactcgtataaaatgaagatgtcggtgatcctgggaattgtccagatggtttttggtgtcatcctcagccttttcaatcacatatacttcagaagaactctcaacatcattctgcaatttatccctgagatgatttttatcctgtgtctgtttggatacctggttttcatgatcattttcaaatggtgctgctttgacgtccacgtatctcagcacgcccccagcatcctcatccacttcatcaacatgtttctgtttaactacagtgactcttccaacgcacccctctacaaacatcagcaagaagtccaaagtttctttgtggttatggctttgatttctgtgccgtggatgcttctgattaagccgtttattcttagagccagtcatcggaaatcccagctgcaggcatccaggatccaagaagatgccactgagaacattgaaggtgatagctccagcccttctagccgttctggccagaggacttctgcagatacccacggggctctggacgaccatggagaagagttcaactttggagacgtctttgtccaccaagccatccacaccatcgagtactgcctgggctgcatttcaaacacagcctcctacctgcggctctgggccctcagcctggctcatgcacaactgtctgaagtgctctggactatggtgatgaacagcggccttcagacgcgaggctggggaggaatcgtcggggtttttattatttttgccgtatttgctgtcctgacagtagccatccttctgatcatggagggcctctctgctttcctgcacgccctgcgactgcactgggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggttgttcttggctcacctgaagcatgaaactgtgtattatttggacgtcagcctgtggatttgatacgacttaaccacgtcagaggaaggactttggcaagtgatattgtcttcatgtggggtattaattctcaaataatatgttaccgacaagccccgcccctaattaatgtgaaacgaaacgtttcggaattata

SEQ ID NO: 286619 - DNA, 1292 bp, Homo sapiens
  misc_feature (1)..(3): n is a, c, g, or t
  misc_feature (5)..(5): n is a, c, g, or t
  misc_feature (918)..(918): n is a, c, g, or t
  misc_feature (920)..(920): n is a, c, g, or t
  misc_feature (1067)..(1067): n is a, c, g, or t
nnnanggaactagaatctggggacaactgcttggtgctgggggaatcagagtgcaggccccaggtttgtgctcagaccccacctgcttaattgcctccactaacgtgacagtcttgccggtgcctggaggcccaaagatgatgtagggggctggacgggtggtgcccgtaacaatgtgcctcatggcctgcagctgctctgggtttgactccagactccggtcgtacagcctggcagagggaccaggaatgtgaacttgaagtcatccagtgacccagaggcctccctgactccaccccctgtgcccacactccaagtggctccagaagctccctgcccacagtctcacttgagtttcacatctgagggcagcagcgggacgtcccgaggtgccacaggaaagagcatgggccacagcagccagcgccctgtcagctccagggcacggtgctggactcgcagcggctggcggttgaaggtaaagttcaccttgaaggtcagcccatccacaaagcggctcaggaggctttgggcagagagaggtggtaagagtttgttggggcaggggaggtgggcaataaagggccagaactttctccaccaaccagtgtcccaacccctctttccaagacctctatgcaagttctctagaagaggaagctgccgtagcatctcagggtacccctgaggaaaagtctcctgctctgccccggggtctcatttatctcagggagaaacactcctcctcccctggggtcagaagtctgtagacccttccagcagctcagggttcccccaacacccacctcatggaaaagctcagcttgacacggtccaattccaccttgtgcacaaagcccttatatgtgatggggtcctcctggtgtgtctccgaggacaaaagggcaaacaggtggncnccccgtagcactgaggggcggctctcagtcactccaggaacctatggggtgtgaacacaagcaagcttctgtcccagggatggacgctggagggcccagcccccaggttccccagacctttaagggacaaggactgagactggcctnctaacctaagactcagggagttatgctatccctgcacccctctttcctttcataccagcaggagtcaggggaagaggaagaagacaaatcctccgaagctgcccagagatgccgagcccaggaacccggagcctccagtgcagctgccctcttggccagctcagttcctgctctgcctataaaaatcctgttcatcagttaatcgggttgctaaaaaaataattt

SEQ ID NO: 286620 - DNA, 450 bp, Homo sapiens
cagaagaggtgtgggaagaaagactccggtcgtacagcctggcagagggaccaggaatgtgaacttgaagtcatccagtgacccagaggcctccctgactccaccccctgtgcccacactccaagtggctccagaagctccctgcccacagtctcacttgagtttcacatctgagggcagcagcgggacgtcccgaggtgccacaggaaagagcatgggccacagcagccagcgccctgtcagctccagggcacggtgctggactcgcagcggctggcggttgaaggagtcaggggaagaggaagaagacaaatcctccgaagctgcccagagatgccgagcccaggaacccggagcctccagtgcagctgccctcttggccagctcagttcctgctctgcctataaaaatcctgttcatcagttaatcgggttgctaaaaaaataattt

SEQ ID NO: 286621 - DNA, 464 bp, Homo sapiens
gcagattgttgcaccattagaagctaggttgatccacagacagatggctgaaagtggaaaagaaaaaataaaatggacaaccaccattattattagctcatctcttaagattcctgggttgtaacttacgaatacttccagtacacaacacagtaaatgctattaatcttatgtgcactatagcaaagactacctccaaaccatacatagatagcatttgctacagaatgataacagctaaagcttacatcattgagcaaagtcctgtttggaaaacacttcagaagataaaactgaatagtgattcagttaacccaaattagagtaccaacttaatgtttttctcgaagaatgtgaaaataattagacctgttaaattataatattcaaatatctatttaaagacatttatattaatttgaaataataacatatacaattaaaagtgattttattttaggagt

SEQ ID NO: 286622 - DNA, 744 bp, Homo sapiens
tctcttatttagcacaagtcattcttttatacagagcacttcaaagaactacctaaattattttgttgtgtaggaattccattatagtactttctattccttatgagtttagggcttggacacatgtggtatacttagttattttggttgattttgagtttataacaaaatttcatctctataacaaagtgacattttatattcaattcacctttcctaggagttgcatttttattaatggatactaaggaatgtcttctgtcaactgaagaaatatttctagccaaaattgagaaatttattaacattcaccaaaatagttttttggttttgtctgctgccctccatgggcctgaagaatggaaactgatgttcaggattcagcagagattcctgggttgtaacttacgaatacttccagtacacaacacagtaaatgctattaatcttatgtgcactatagcaaagactacctccaaaccatacatagatagcatttgctacagaatgataacagctaaagcttacatcattgagcaaagtcctgtttggaaaacacttcagaagataaaactgaatagtgattcagttaacccaaattagagtaccaacttaatgtttttctcgaagaatgtgaaaataattagacctgttaaattataatattcaaatatctatttaaagacatttatattaatttgaaataataacatatacaattaaaagtgattttattttaggagt

SEQ ID NO: 286623 - DNA, 587 bp, Homo sapiens
tctcttatttagcacaagtcattcttttatacagagcacttcaaagaactacctaaattattttgttgtgtaggaattccattatagtactttctattccttatgagtttagggcttggacacatgtggtatacttagttattttggttgattttgagtttataacaaaatttcatctctataacaaagtgacattttatattcaattcacctttcctaggagttgcatttttattaatggatactaaggaatgtcttctgtcaactgaagaaatatttctagccaaaattgagaaatttattaacattcaccaaaatagttttttggttttgtctgctgccctccatgggcctgaagaatggaaactgatgttcaggattcagcagaggtatggaagaatagcattatagacttatttttcttatattgtatttatttcagttcttaattcttttaggtaagttttgttttgctagatgatgaacactgtgatgttaacctatcaaatttaatgaaacatgggccaaatagctattctatgaatcgaggtgacagggttcatgatgttgcaagggcttctccaaga

SEQ ID NO: 286624 - DNA, 586 bp, Homo sapiens
gtcctctgcaaagtgtgcccagacacctccaaccccctaggcagacttaggtcttccttgcttttatacttggaacatatccccattaaagcaatttttatatattctactttttggcgtgcatgtttaaaattccttgatagaaactaagtattttcgtgttgactactctagtaactcacacagagtatttagcacaaagatgatcaagagatttgctgaaagaatgaaagtcaggtatttttaaatgtcaccgtgtgaaaacaccttatttctgtaaataatgctgcatctttatatcttcttccagactacctccaaaccatacatagatagcatttgctacagaatgataacagctaaagcttacatcattgagcaaagtcctgtttggaaaacacttcagaagataaaactgaatagtgattcagttaacccaaattagagtaccaacttaatgtttttctcgaagaatgtgaaaataattagacctgttaaattataatattcaaatatctatttaaagacatttatattaatttgaaataataacatatacaattaaaagtgattttattttaggagt

SEQ ID NO: 286625 - DNA, 490 bp, Homo sapiens
cttaattcttttaggtaagttttgttttgctagatgatgaacactgtgatgttaacctatcaaatttaatgaaacatgggccaaatagctattctatgaatcgaggtgacagggttcatgatgttgcaagggcttctccaagaccaagccaaaagtgaacacttttttagtcagtgatgttctggctataaagccatctcaaatcctctgtggagtaaggcagggcatgaatgcatagacaaataacaaacaatagagatttgtctcttctttccactttcttaagagaacagatgtcagcaagttatatgatctgtataacatgaattgtttttcagattcctgggttgtaacttacgaatacttccagtacacaacacagtaaatgctattaatcttatgtgcactatagcaaaggtgagtcacccgtggaatatgacacatacacacatacattttaaggtttttaacttccaattgtcaccctttt

SEQ ID NO: 286626 - DNA, 1285 bp, Homo sapiens
gacggaagcaaaggagccaagaccatggcgaaagccggggataagagcggcagcagcgggaagaaaagtctaaaacggaaagccgctgccgaagaacttcaggaggctgcaggcgctggggatggggcgacggaaaacggggtccaacccccgaaagcggctgcctttccgccaggctttagcatttcggagattaaaaacaaacagcggcgacacttaatgttcacgcggtggaaacagcagcagcggaaggaaaagttggcagctaagaaaaaacttaaaaaagaaagagaggctcttggcgataaggctccaccaaagcctgtacccaagaccattgacaaccagcgagtgtatgatgaaaccacagtagaccctaatgatgaagaggtcgcttatgatgaagctacagatgaatttgcttcttacttcaacaaacagacttctcccaagattctcatcacaacatcagatagacctcatgggagaacagtacgactctgtgaacagctctccacagttataccaaactcacatgtttattacagaagaggactggctctgaaaaaaattattccacagtgcatcgcaagagatttcacagacctgattgttattaatgaagatcgtaaaaccccaaatggacttattttgagtcacttgccaaatggcccaactgctcattttaaaatgagcagtgttcgtcttcgtaaagaaattaagagaagaggcaaggaccccacagaacacatacctgaaataattctgaataattttacaacacggctgggtcattcaattggacgtatgtttgcatctctctttcctcataatcctcaatttatcggaaggcaggttgccacattccacaatcaacgggattacatattcttcagatttcacagatacatattcaggagtgaaaagaaagtgggaattcaggaacttggaccacgttttaccttaaaattaaggtctcttcagaaaggaacctttgattctaaatatggagagtatgaatgggtccataagccccgggaaatggatacaagtagaagaaaattccatttataaagtactgagagaatgatattggattttgctgaacaggcctatcttgaactttggtaaattatttttgacagaatactcttttcaaaatggcatttgctgatttcataaacctttcacgtctggacgaattaccaaatgccatgaattgccactgtgtgtttatgtagaaaatacaaataaaagttattttgatggcttaggtttccttaaa

SEQ ID NO: 286627 - DNA, 801 bp, Homo sapiens
cgcaattaattctttagtcagatctcatcaataattaaaatggtcagtcaatctaggtccccatcagatataaagcccgcgcccatataaaccctacacatcgcacgtcaaataattcgacgtgcgtattatacacctccaaaaactgaatgtaatatttgtgaaatccctatccagtggacctaactgactatttttaaaagaacaaagttgcttttccacaattgcctaaagaagcatcaccagtccccctaaggaccacacaccttaataaatttgcactattatcaaaagccggccggatcattaaactcgaaaagaaagaagataccttcctccccctaaaatcctccataaaaacgaaagacaaggttgccacatccatcaatcagggggataacaaattcctcagatttcacaaatacatattcaggagtgaaaagaaagtgggaattcaggaacttggaccacgttttaccttaaaattaaggtctcttcagaaaggaacctttgattctaaatatggagagtatgaatgggtccataagccccgggaaatggatacaagtagaagaaaattccatttataaagtactgagagaatgatattggattttgctgaacaggcctatcttgaactttggtaaattatttttgacagaatactcttttcaaaatggcatttgctgatttcataaacctttcacgtctggacgaattaccaaatgccatgaattgccactgtgtgtttatgtagaaaatacaaataaaagttattttgatggcttaggtttccttaaa

SEQ ID NO: 286628 - DNA, 1468 bp, Homo sapiens
gacggaagcaaaggagccaagaccatggcgaaagccggggataagagcggcagcagcgggaagaaaagtctaaaacggaaagccgctgccgaagaacttcaggaggctgcaggcgctggggatggggcgacggaaaacggggtccaacccccgaaagcggctgcctttccgccaggctttagcatttcggagattaaaaacaaacagcggcgacacttaatgttcacgcggtggaaacagcagcagcggaaggaaaagttggcagctaagaaaaaacttaaaaaagaaagagaggctcttggcgataaggctccaccaaagcctgtacccaagaccattgacaaccagcgagtgtatgatgaaaccacagtagaccctaatgatgaagaggtcgcttatgatgaagctacagatgaatttgcttcttacttcaacaaacagacttctcccaagattctcatcacaacatcagatagacctcatgggagaacagtacgactctgtgaacagctctccacagttataccaaactcacatgtttattacagaagaggactggctctgaaaaaaattattccacagtgcatcgcaagagatttcacagacctgattgttattaatgaagatcgtaaaaccccaaatggacttattttgagtcacttgccaaatggcccaactgctcattttaaaatgagcagtgttcgtcttcgtaaagaaattaagagaagaggcaaggaccccacagaacacatacctgaaataattctgaataattttacaacacggctgggtcattcaattggacgtatgtttgcatctctctttcctcataatcctcaatttatcggaaggcaggttgccacattccacaatcaacgggattacatattcttcagatttcacagatacatattcaggagtgaaaagaaagtgggaattcaggaacttggaccacgttttaccttaaaattaaggtctcttcagaaaggaacctttgattctaaatatggagagtatgaatgggtccataagccccgggaaatggatacaagtagaagaaaattccatttataaagtactgagagaatgatattggattttgctgaacaggcctatcttgaactttggtaaattatttttgacagaatactcttttcaaaatggcatttgctgatttcataaacctttcacgtctggacgaattaccaaatgccatgaattgccactgtgtgtttatgtagaaaatacaaataaaagttattttgatggcttaggtttccttaaaaaaaaaaaaaaaaaaaaaaaaaaaaaaaaaaaaaaagcagaataaaacaagaaaagaacagaaccgaaaccaaagaccaccaagcacacagaaatgccacagagaaagaacgaagcacacaacccacgcaaaaggagaaacgaaaggagcagagaaaaaaataaaccaacagaagagggagac

SEQ ID NO: 286629 - DNA, 1205 bp, Homo sapiens
gacggaagcaaaggagccaagagcctctctttctttttttaagttttttcttagctgccaacttttccttccgcaagcggctgcctttccgccaggctttagcatttcggagattaaaaacaaacagcggcgacacttaatgttcacgcggtggaaacagcagcagcggaaggaaaagttggcagctaagaaaaaacttaaaaaagaaagagaggctcttggcgataaggctccaccaaagcctgtacccaagaccattgacaaccagcgagtgtatgatgaaaccacagtagaccctaatgatgaagaggtcgcttatgatgaagctacagatgaatttgcttcttacttcaacaaacagacttctcccaagattctcatcacaacatcagatagacctcatgggagaacagtacgactctgtgaacagctctccacagttataccaaactcacatgtttattacagaagaggactggctctgaaaaaaattattccacagtgcatcgcaagagatttcacagacctgattgttattaatgaagatcgtaaaaccccaaatggacttattttgagtcacttgccaaatggcccaactgctcattttaaaatgagcagtgttcgtcttcgtaaagaaattaagagaagaggcaaggaccccacagaacacatacctgaaataattctgaataattttacaacacggctgggtcattcaattggacgtatgtttgcatctctctttcctcataatcctcaatttatcggaaggcaggttgccacattccacaatcaacgggattacatattcttcagatttcacagatacatattcaggagtgaaaagaaagtgggaattcaggaacttggaccacgttttaccttaaaattaaggtctcttcagaaaggaacctttgattctaaatatggagagtatgaatgggtccataagccccgggaaatggatacaagtagaagaaaattccatttataaagtactgagagaatgatattggattttgctgaacaggcctatcttgaactttggtaaattatttttgacagaatactcttttcaaaatggcatttgctgatttcataaacctttcacgtctggacgaattaccaaatgccatgaattgccactgtgtgtttatgtagaaaatacaaataaaagttattttgatggcttaggtttccttaaa

SEQ ID NO: 286630 - DNA, 428 bp, Homo sapiens
atgaatatgtaccacataagatttttattcttttttgaaaactattcaaaatttttgttattttgttttgcagagaacagtacgactctgtgaacagctctccacagttataccaaactcacatgtttattacagaagaggactggctctgaaaaaaattattccacagtgcatcgcaagagatttcacagacctgattgttattaatgaagatcgtaaaaccccaagtatcctttttttttttaaggaggttttcctgtcctctccctcaccccccttaaaaatatatttaaaagaataaggaaatattgcctataactttcagaaaataatttttttatcagaaaattgtatctctttccaagagtctataaactgatttttcctttgtattcaccaaacatttatcaggcacatgctacagccaa

SEQ ID NO: 286631 - DNA, 1793 bp, Homo sapiens
gacggaagcaaaggagccaagaccatggcgaaagccggggataagagcggcagcagcgggaagaaaagtctaaaacggaaagccgctgccgaagaacttcaggaggctgcaggcgctggggatggggcgacggaaaacggggtccaacccccgaaagcggctgcctttccgccaggctttagcatttcggagattaaaaacaaacagcggcgacacttaatgttcacgcggtggaaacagcagcagcggaaggaaaagttggcagctaagaaaaaacttaaaaaagaaagagaggctcttggcgataaggctccaccaaagcctgtacccaagaccattgacaaccagcgagtgtatgatgaaaccacagtagaccctaatgatgaagaggtcgcttatgatgaagctacagatgaatttgcttcttacttcaacaaacagacttctcccaagattctcatcacaacatcagatagacctcatgggagaacagtacgactctgtgaacagctctccacagttataccaaactcacatgtttattacagaagaggactggctctgaaaaaaattattccacagtgcatcgcaagagatttcacagacctgattgttattaatgaagatcgtaaaaccccaaatggacttattttgagtcacttgccaaatggcccaactgctcattttaaaatgagcagtgttcgtcttcgtaaagaaattaagagaagaggcaaggaccccacagaacacatacctgaaataattctgaataattttacaacacggctgggtcattcaattggacgtatgtttgcatctctctttcctcataatcctcaatttatcggaaggcaggttgccacattccacaatcaacgggattacatattcttcagatttcacagatacatattcaggagtgaaaagaaagtgggaattcaggaacttggaccacgttttaccttaaaattaaggtctcttcagaaaggaacctttgattctaaatatggagagtatgaatgggtccataagccccgggaaatggatacaagtagaagaaaattccatttataaagtactgagagaatgatattggattttgctgaacaggcctatcttgaactttggtaaattatttttgacagaatactcttttcaaaatggcatttgctgatttcataaacctttcacgtctggacgaattaccaaatgccatgaattgccactgtgtgtttatgtagaaaatacaaataaaagttattttgatggcttaggtttccttaaacttagttctcttgtttttgggtaactgtgaataattaagttggaatcaagattcagattaactttcctatttgcatagaacacatgagaggaataaaatggttggtaaatattggctaacccttgatttttataccagattaaccttggattcccagtgtctggcacagttttaatagcttaaatggaggccaggtttctggatgttttaacattctcttaagccttcagaagggtaaaaaatttaaagcaaaatgatctaccagggtttaaagcaaagttgcaaattactgaagctaatctttgcttcctgattttgaggtttttggttttttgtgcccacgttgtggggagctcttttttacctcattacatggtgctgtagtactccattcaggcactgaaacaaagttaaccctataagtaactcatggatggaaacccgtagaacttaacagcctcctcctgaccttaaaagaataaaggttcacagtttacctttaattccc

SEQ ID NO: 286632 - DNA, 908 bp, Homo sapiens
gacggaagcaaaggagccaagaccatggcgaaagccggggataagagcggcagcagcgggaagaaaagtctaaaacggaaagccgctgccgaagaacttcaggaggctgcaggcgctggggatggggcgacggaaaacggggtccaacccccgaaagcggctgcctttccgccaggctttagcatttcggagattaaaaacaaacagcggcgacacttaatgttcacgcggtggaaacagcagcagcggaaggaaaagttggcagctaagaaaaaacttaaaaaagaaagagaggctcttggcgataaggctccaccaaagcctgtacccaagaccattgacaaccagcgagtgtatgatgaaaccacagtagaccctaatgatgaagaggtcgcttatgatgaagctacagatgaatttgcttcttacttcaacaaacagacttctcccaagattctcatcacaacatcagatagacctcatgggagaacagtacgactctgtgaacagctctccacagttataccaaactcacatgtttattacagaagaggactggctctgaaaaaaattattccacagtgcatcgcaagagatttcacagacctgattgttattaatgaagatcgtaaaaccccaaatggacttattttgagtcacttgccaaatggcccaactgctcattttaaaatgagcagtgttcgtcttcgtaaagaaattaagagaagaggcaaggaccccacagaacacatacctgaaataattctgaataattttacaacacggctgggtcattcaattggacgtatgtttgcatctctctttcctcataatcctcaatttatcggaaggcaggttgcccacaattttccccccacaaccccccaaaaaaaaattttttttccccc

SEQ ID NO: 286633 - DNA, 1394 bp, Homo sapiens
  misc_feature (105)..(105): n is a, c, g, or t
agcaaccatgtactctgcgagcatgggggacaaggcgattgcagcatcagtgatgtgtgcgagacgcaggatggagattagcctcgcgccaccccgttagtcagnaggcacaatgtacaacgcatcggctgcaggcgtcgtctcgagcgcgtatgcgtggcagaataggactacaccgaggaggtagcaaactcagcggatgatctgcgtttgcacctctatccaggctcgcgtctcctcatcttctactccagcaaggacttcacatcatccaacattcgccgagaggagacgacttcactggtccaaccgctgcgagcgaacaatatatccatcgacacaaggatgcggtgcgtatcatgaacaagaaccgcatttagagatagtgtagtagagttcatgaagccgatatgtgatctaccgaattcattggtccgccggattcattgacaaccagcgagtgtatgatgaaaccacagtagaccctaatgatgaagaggtcgcttatgatgaagctacagatgaatttgcttcttacttcaacaaacagacttctcccaagattctcatcacaacatcagatagacctcatgggagaacagtacgactctgtgaacagctctccacagttataccaaactcacatgtttattacagaagaggactggctctgaaaaaaattattccacagtgcatcgcaagagatttcacagacctgattgttattaatgaagatcgtaaaaccccaaatggacttattttgagtcacttgccaaatggcccaactgctcattttaaaatgagcagtgttcgtcttcgtaaagaaattaagagaagaggcaaggaccccacagaacacatacctgaaataattctgaataattttacaacacggctgggtcattcaattggacgtatgtttgcatctctctttcctcataatcctcaatttatcggaaggcaggttgccacattccacaatcaacgggattacatattcttcagatttcacagatacatattcaggagtgaaaagaaagtgggaattcaggaacttggaccacgttttaccttaaaattaaggtctcttcagaaaggaacctttgattctaaatatggagagtatgaatgggtccataagccccgggaaatggatacaagtagaagaaaattccatttataaagtactgagagaatgatattggattttgctgaacaggcctatcttgaactttggtaaattatttttgacagaatactcttttcaaaatggcatttgctgatttcataaacctttcacgtctggacgaattaccaaatgccatgaattgccactgtgtgtttatgtagaaaatacaaataaaagttattttgatggcttaggtttccttaaa

SEQ ID NO: 286634 - DNA, 2825 bp, Homo sapiens
aaaaaaaaaagaaaaaaaaaaaactcttgtgtagcctgaggcggcggtagcatggagggggagagtacgtcggcggtgctctcgggctttgtgctcggcgcactcgctttccagcacctcaacacggactcggacacggaaggttttcttcttggggaagtaaaaggtgaagccaagaacagcattactgattcccaaatggatgatgttgaagttgtttatacaattgacattcagaaatatattccatgctatcagctttttagcttttataattcttcaggcgaagtaaatgagcaagcactgaagaaaatattatcaaatgtcaaaaagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacattccttatataaacctcaaaaaggactttttcacagggtacctttagtggttgccaatctgggcatgtctgaacaactgggttataaaactgtatcaggttcctgtatgtccactggttttagccgagcagtacaaacacacagctctaaattttttgaagaagatggatccttaaaggaggtacataagataaatgaaatgtatgcttcattacaagaggaattaaagagtatatgcaaaaaagtggaagacagtgaacaagcagtagataaactagtaaaggatgtaaacagattaaaacgagaaattgagaaaaggagaggagcacagattcaggcagcaagagagaagaacatccaaaaagaccctcaggagaacatttttctttgtcaggcattacggaccttttttccaaattctgaatttcttcattcatgtgttatgtctttaaaaaatagacatgtttctaaaagtagctgtaactacaaccaccatctcgatgtagtagacaatctgaccttaatggtagaacacactgacattcctgaagctagtccagctagtacaccacaaatcattaagcataaagccttagacttagatgacagatggcaattcaagagatctcggttgttagatacacaagacaaacgatctaaagcagatactggtagtagtaaccaagataaagcatccaaaatgagcagcccagaaacagatgaagaaattgaaaagatgaagggttttggtgaatattcacggtctcctacattttgatccttttaaccttacaaggagatttttttatttggctgatgggtaaagccaaacatttctattgtttttactatgttgagctacttgcagtaagttcatttgtttttactatgttcacctgtttgcagtaatacacagataactcttagtgcatttacttcacaaagtactttttcaaacatcagatgcttttatttccaaacctttttttcacctttcactaagttgttgaggggaaggcttacacagacacattctttagaattggaaaagtgagaccaggcacagtggctcacacctgtaatcccagcacttagggaagacaagtcaggaggattgattgaagctaggagttagagaccagcctgggcaacgtattgagaccatgtctattaaaaaataaaatggaaaagcaagaatagccttattttcaaaatatggaaagaaatttatatgaaaatttatctgagtcattaaaattctccttaagtgatacttttttagaagtacattatggctagagttgccagataaaatgctggatatcatgcaataaatttgcaaaacatcatctaaaatttaaatttgtcctacatttgtacttgctaaatctggcagccttaattattacacaactataacacaacacaaacagtaatctctcccctagtttagagtcctttgcatgaaatttagcaaatctatcattttgaatacagtacaagcctggtaatccagtgtatttgggataggccagtggaactcagaactgatacatatatacatgtatgtctatcatattcaatgtctattaggtgtaaatcatctcttcatgtaaaagacactactggtttgagggtagactcgtctaggaatattttgtccttctgtgacagcaccactatccatcccaatgtaacatttctacaaagggaagatatcttaaccaggcatacttatatttgctagttggaaaatcattctgaacagttttaattccattctattgaatggattattgtatgagctatttggggatcagatataaatgacaatcacacagaaccacttttattcaacatagataaaatgtgatgagtgttaacattttaaataagcaatctgcttaatggacattggtatgaaggggaagtgtcattctttacctcactcctcaaacacttttctatccaaaggttggtttgagtcagtattggcatcatacaaccacttactgtaaaataagtttattagtggtaacgtgatagaatttattcccgatatctgatgttacaaactttagggtccttgagatatgcaggatccttgtatgtaactggcataaaccctgtaaagagataattaaagttcttgacaaaacataatgagcaaaatttcagctagctcaattcagttgttgaggtattctttcttacccattatttgagctctcttaattgcttttgtgatttctttctgtttcttcccacaaagacctgtaaaataaaaagctttcttattcataaaaaatgtcaatatttaaa

SEQ ID NO: 286635 - DNA, 452 bp, Homo sapiens
acgttgagctcggaagtagttaatgtcctgtagcactttcagtaacttgcagaaagaaagtctaagcatctgaaatacacttccctgctgtgtggtacagttcggagaataccctgctgaacaatgcctagtaatttctgctaagttcattttaagatataacgtctattttactcaaaattgccttaatataggtcgggcgcggtggctcacgcctgtaattccagccctttgggaagccgaggcgggtgaatcacctgagcccacgagttcgagaccatcggggacaacgtagtgagacccggtctctacaaaatctaaacattacaaaattgctctttggcacaatcctaataaaggttggaattggtatgttttatgtatacaatttcagataaccttacaaagtaatacctaataaagaacaaatatatgaccatttaaaatatatg

SEQ ID NO: 286636 - DNA, 3048 bp, Homo sapiens
atttagaatttaagcctagatacttcagcagtttttctataactgaacaaagaaacaaagtagctcttgatggtccagtaaaatgagtctaaccagggactccttacaggttttatatatagtaaactacattttcgtggaatatgagaattacgttaaaagagtaccaactaagaataattttattgttcatggaagatagggtaaatctcaatactgccttatttatacatgtactaatcaaaagagccattaaactgtttttccacactattatactaagcacatttcacagctttacatgtcatctgggcccagtgtggtgactcatacctgtaatcccagcactttgggaggccaaggcaggaggatcactgagcaacattaggagacctcatctctacaaaaaacttaaaaattggtcgggtgtggtgatgggtgcctgtagtcccagctacttgggaggctgaggcaagaggattgcttgagcacgggaggttgaagctgcattattgagccatgatcgcaccactgcactgcagcctgggagactgagtgagaccctgtctcaaaaaaaaaaaaaaacagttgtttcaagtcagtaaattctattttggataagtagtaaagaatgggttttggggggtgtatttttttaaatcttgtaggggacaagtaatctattccagcaggtagatactaatctttcttttcattctaagtttatactctaaagttttattttgtcagactttttcacagggtacctttagtggttgccaatctgggcatgtctgaacaactgggttataaaactgtatcaggttcctgtatgtccactggttttagccgagcagtacaaacacacagctctaaattttttgaagaagatggatccttaaaggaggtacataagataaatgaaatgtatgcttcattacaagaggaattaaagagtatatgcaaaaaagtggaagacagtgaacaagcagtagataaactagtaaaggatgtaaacagattaaaacgagaaattgagaaaaggagaggagcacagattcaggcagcaagagagaagaacatccaaaaagaccctcaggagaacatttttctttgtcaggcattacggaccttttttccaaattctgaatttcttcattcatgtgttatgtctttaaaaaatagacatgtttctaaaagtagctgtaactacaaccaccatctcgatgtagtagacaatctgaccttaatggtagaacacactgacattcctgaagctagtccagctagtacaccacaaatcattaagcataaagccttagacttagatgacagatggcaattcaagagatctcggttgttagatacacaagacaaacgatctaaagcagatactggtagtagtaaccaagataaagcatccaaaatgagcagcccagaaacagatgaagaaattgaaaagatgaagggttttggtgaatattcacggtctcctacattttgatccttttaaccttacaaggagatttttttatttggctgatgggtaaagccaaacatttctattgtttttactatgttgagctacttgcagtaagttcatttgtttttactatgttcacctgtttgcagtaatacacagataactcttagtgcatttacttcacaaagtactttttcaaacatcagatgcttttatttccaaacctttttttcacctttcactaagttgttgaggggaaggcttacacagacacattctttagaattggaaaagtgagaccaggcacagtggctcacacctgtaatcccagcacttagggaagacaagtcaggaggattgattgaagctaggagttagagaccagcctgggcaacgtattgagaccatgtctattaaaaaataaaatggaaaagcaagaatagccttattttcaaaatatggaaagaaatttatatgaaaatttatctgagtcattaaaattctccttaagtgatacttttttagaagtacattatggctagagttgccagataaaatgctggatatcatgcaataaatttgcaaaacatcatctaaaatttaaatttgtcctacatttgtacttgctaaatctggcagccttaattattacacaactataacacaacacaaacagtaatctctcccctagtttagagtcctttgcatgaaatttagcaaatctatcattttgaatacagtacaagcctggtaatccagtgtatttgggataggccagtggaactcagaactgatacatatatacatgtatgtctatcatattcaatgtctattaggtgtaaatcatctcttcatgtaaaagacactactggtttgagggtagactcgtctaggaatattttgtccttctgtgacagcaccactatccatcccaatgtaacatttctacaaagggaagatatcttaaccaggcatacttatatttgctagttggaaaatcattctgaacagttttaattccattctattgaatggattattgtatgagctatttggggatcagatataaatgacaatcacacagaaccacttttattcaacatagataaaatgtgatgagtgttaacattttaaataagcaatctgcttaatggacattggtatgaaggggaagtgtcattctttacctcactcctcaaacacttttctatccaaaggttggtttgagtcagtattggcatcatacaaccacttactgtaaaataagtttattagtggtaacgtgatagaatttattcccgatatctgatgttacaaactttagggtccttgagatatgcaggatccttgtatgtaactggcataaaccctgtaaagagataattaaagttcttgacaaaacataatgagcaaaatttcagctagctcaattcagttgttgaggtattctttcttacccattatttgagctctcttaattgcttttgtgatttctttctgtttcttcccacaaagacctgtaaaataaaaagctttcttattcataaaaaatgtcaatatttaaa

SEQ ID NO: 286637 - DNA, 2888 bp, Homo sapiens
cgtgcgccggcgcaggccccgcctcctcgctgggccccgcctcgctgccaccacagggtcttgcctccgcgcgccccgccctcgtcctcttgtgtagcctgaggcggcggtagcatggagggggagagtacgtcggcggtgctctcgggctttgtgctcggcgcactcgctttccagcacctcaacacggactcggacacggaaggttttcttcttggggaagtaaaaggtgaagccaagaacagcattactgattcccaaatggatgatgttgaagttgtttatacaattgacattcagaaatatattccatgctatcagctttttagcttttataattcttcaggcgaagtaaatgagcaagcactgaagaaaatattatcaaatgtcaaaaagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacattccttatataaacctcaaaaaggactttttcacagggtacctttagtggttgccaatctgggcatgtctgaacaactgggttataaaactgtatcaggttcctgtatgtccactggttttagccgagcagtacaaacacacagctctaaattttttgaagaagatggatccttaaaggaggtacataagataaatgaaatgtatgcttcattacaagaggaattaaagagtatatgcaaaaaagtggaagacagtgaacaagcagtagataaactagtaaaggatgtaaacagattaaaacgagaaattgagaaaaggagaggagcacagattcaggcagcaagagagaagaacatccaaaaagaccctcaggagaacatttttctttgtcaggcattacggaccttttttccaaattctgaatttcttcattcatgtgttatgtctttaaaaaatagacatgtttctaaaagtagctgtaactacaaccaccatctcgatgtagtagacaatctgaccttaatggtagaacacactgacattcctgaagctagtccagctagtacaccacaaatcattaagcataaagccttagacttagatgacagatggcaattcaagagatctcggttgttagatacacaagacaaacgatctaaagcagatactggtagtagtaaccaagataaagcatccaaaatgagcagcccagaaacagatgaagaaattgaaaagatgaagggttttggtgaatattcacggtctcctacattttgatccttttaaccttacaaggagatttttttatttggctgatgggtaaagccaaacatttctattgtttttactatgttgagctacttgcagtaagttcatttgtttttactatgttcacctgtttgcagtaatacacagataactcttagtgcatttacttcacaaagtactttttcaaacatcagatgcttttatttccaaacctttttttcacctttcactaagttgttgaggggaaggcttacacagacacattctttagaattggaaaagtgagaccaggcacagtggctcacacctgtaatcccagcacttagggaagacaagtcaggaggattgattgaagctaggagttagagaccagcctgggcaacgtattgagaccatgtctattaaaaaataaaatggaaaagcaagaatagccttattttcaaaatatggaaagaaatttatatgaaaatttatctgagtcattaaaattctccttaagtgatacttttttagaagtacattatggctagagttgccagataaaatgctggatatcatgcaataaatttgcaaaacatcatctaaaatttaaatttgtcctacatttgtacttgctaaatctggcagccttaattattacacaactataacacaacacaaacagtaatctctcccctagtttagagtcctttgcatgaaatttagcaaatctatcattttgaatacagtacaagcctggtaatccagtgtatttgggataggccagtggaactcagaactgatacatatatacatgtatgtctatcatattcaatgtctattaggtgtaaatcatctcttcatgtaaaagacactactggtttgagggtagactcgtctaggaatattttgtccttctgtgacagcaccactatccatcccaatgtaacatttctacaaagggaagatatcttaaccaggcatacttatatttgctagttggaaaatcattctgaacagttttaattccattctattgaatggattattgtatgagctatttggggatcagatataaatgacaatcacacagaaccacttttattcaacatagataaaatgtgatgagtgttaacattttaaataagcaatctgcttaatggacattggtatgaaggggaagtgtcattctttacctcactcctcaaacacttttctatccaaaggttggtttgagtcagtattggcatcatacaaccacttactgtaaaataagtttattagtggtaacgtgatagaatttattcccgatatctgatgttacaaactttagggtccttgagatatgcaggatccttgtatgtaactggcataaaccctgtaaagagataattaaagttcttgacaaaacataatgagcaaaatttcagctagctcaattcagttgttgaggtattctttcttacccattatttgagctctcttaattgcttttgtgatttctttctgtttcttcccacaaagacctgtaaaataaaaagctttcttattcataaaaaatgtcaatatttaaa

SEQ ID NO: 286638 - DNA, 2945 bp, Homo sapiens
cccctgggacttctaataccccaacactacaaagctttagattttcagtattcgtaaggaaaggtgtgatacctttcctcactcatcaccagggtcacagccaacagccctataacaaaagacaggttaacaagagaaaagaacgacaaatttatttaatcaaagtttaacacgacataggcgccttcagaaatgaagacctcaagccccaaggaaaactgtctatttttatgcttcacttcgatgaagaatggacaggaaggttttcttcttggggaagtaaaaggtgaagccaagaacagcattactgattcccaaatggatgatgttgaagttgtttatacaattgacattcagaaatatattccatgctatcagctttttagcttttataattcttcaggcgaagtaaatgagcaagcactgaagaaaatattatcaaatgtcaaaaagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacattccttatataaacctcaaaaaggactttttcacagggtacctttagtggttgccaatctgggcatgtctgaacaactgggttataaaactgtatcaggttcctgtatgtccactggttttagccgagcagtacaaacacacagctctaaattttttgaagaagatggatccttaaaggaggtacataagataaatgaaatgtatgcttcattacaagaggaattaaagagtatatgcaaaaaagtggaagacagtgaacaagcagtagataaactagtaaaggatgtaaacagattaaaacgagaaattgagaaaaggagaggagcacagattcaggcagcaagagagaagaacatccaaaaagaccctcaggagaacatttttctttgtcaggcattacggaccttttttccaaattctgaatttcttcattcatgtgttatgtctttaaaaaatagacatgtttctaaaagtagctgtaactacaaccaccatctcgatgtagtagacaatctgaccttaatggtagaacacactgacattcctgaagctagtccagctagtacaccacaaatcattaagcataaagccttagacttagatgacagatggcaattcaagagatctcggttgttagatacacaagacaaacgatctaaagcagatactggtagtagtaaccaagataaagcatccaaaatgagcagcccagaaacagatgaagaaattgaaaagatgaagggttttggtgaatattcacggtctcctacattttgatccttttaaccttacaaggagatttttttatttggctgatgggtaaagccaaacatttctattgtttttactatgttgagctacttgcagtaagttcatttgtttttactatgttcacctgtttgcagtaatacacagataactcttagtgcatttacttcacaaagtactttttcaaacatcagatgcttttatttccaaacctttttttcacctttcactaagttgttgaggggaaggcttacacagacacattctttagaattggaaaagtgagaccaggcacagtggctcacacctgtaatcccagcacttagggaagacaagtcaggaggattgattgaagctaggagttagagaccagcctgggcaacgtattgagaccatgtctattaaaaaataaaatggaaaagcaagaatagccttattttcaaaatatggaaagaaatttatatgaaaatttatctgagtcattaaaattctccttaagtgatacttttttagaagtacattatggctagagttgccagataaaatgctggatatcatgcaataaatttgcaaaacatcatctaaaatttaaatttgtcctacatttgtacttgctaaatctggcagccttaattattacacaactataacacaacacaaacagtaatctctcccctagtttagagtcctttgcatgaaatttagcaaatctatcattttgaatacagtacaagcctggtaatccagtgtatttgggataggccagtggaactcagaactgatacatatatacatgtatgtctatcatattcaatgtctattaggtgtaaatcatctcttcatgtaaaagacactactggtttgagggtagactcgtctaggaatattttgtccttctgtgacagcaccactatccatcccaatgtaacatttctacaaagggaagatatcttaaccaggcatacttatatttgctagttggaaaatcattctgaacagttttaattccattctattgaatggattattgtatgagctatttggggatcagatataaatgacaatcacacagaaccacttttattcaacatagataaaatgtgatgagtgttaacattttaaataagcaatctgcttaatggacattggtatgaaggggaagtgtcattctttacctcactcctcaaacacttttctatccaaaggttggtttgagtcagtattggcatcatacaaccacttactgtaaaataagtttattagtggtaacgtgatagaatttattcccgatatctgatgttacaaactttagggtccttgagatatgcaggatccttgtatgtaactggcataaaccctgtaaagagataattaaagttcttgacaaaacataatgagcaaaatttcagctagctcaattcagttgttgaggtattctttcttacccattatttgagctctcttaattgcttttgtgatttctttctgtttcttcccacaaagacctgtaaaataaaaagctttcttattcataaaaaatgtcaatatttaaa

SEQ ID NO: 286639 - DNA, 3005 bp, Homo sapiens
cgtgcgccggcgcaggccccgcctcctcgctgggccccgcctcgctgccaccacagggtcttgcctccgcgcgccccgccctcgtcctcttgtgtagcctgaggcggcggtagcatggagggggagagtacgtcggcggtgctctcgggctttgtgctcggcgcactcgctttccagcacctcaacacggactcggacacgggtcgggcgcggtggctcacgcctgtaattccagccctttgggaagccgaggcgggtgaatcacctgagcccacgagttcgagaccatcggggacaacgtagtgagacccggtctctacaaaatctaaacattacaaaattgctctttggcacaatcctaataaaggttggaattggtatgttttaaggttttcttcttggggaagtaaaaggtgaagccaagaacagcattactgattcccaaatggatgatgttgaagttgtttatacaattgacattcagaaatatattccatgctatcagctttttagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacattccttatataaacctcaaaaaggactttttcacagggtacctttagtggttgccaatctgggcatgtctgaacaactgggttataaaactgtatcaggttcctgtatgtccactggttttagccgagcagtacaaacacacagctctaaattttttgaagaagatggatccttaaaggaggtacataagataaatgaaatgtatgcttcattacaagaggaattaaagagtatatgcaaaaaagtggaagacagtgaacaagcagtagataaactagtaaaggatgtaaacagattaaaacgagaaattgagaaaaggagaggagcacagattcaggcagcaagagagaagaacatccaaaaagaccctcaggagaacatttttctttgtcaggcattacggaccttttttccaaattctgaatttcttcattcatgtgttatgtctttaaaaaatagacatgtttctaaaagtagctgtaactacaaccaccatctcgatgtagtagacaatctgaccttaatggtagaacacactgacattcctgaagctagtccagctagtacaccacaaatcattaagcataaagccttagacttagatgacagatggcaattcaagagatctcggttgttagatacacaagacaaacgatctaaagcagatactggtagtagtaaccaagataaagcatccaaaatgagcagcccagaaacagatgaagaaattgaaaagatgaagggttttggtgaatattcacggtctcctacattttgatccttttaaccttacaaggagatttttttatttggctgatgggtaaagccaaacatttctattgtttttactatgttgagctacttgcagtaagttcatttgtttttactatgttcacctgtttgcagtaatacacagataactcttagtgcatttacttcacaaagtactttttcaaacatcagatgcttttatttccaaacctttttttcacctttcactaagttgttgaggggaaggcttacacagacacattctttagaattggaaaagtgagaccaggcacagtggctcacacctgtaatcccagcacttagggaagacaagtcaggaggattgattgaagctaggagttagagaccagcctgggcaacgtattgagaccatgtctattaaaaaataaaatggaaaagcaagaatagccttattttcaaaatatggaaagaaatttatatgaaaatttatctgagtcattaaaattctccttaagtgatacttttttagaagtacattatggctagagttgccagataaaatgctggatatcatgcaataaatttgcaaaacatcatctaaaatttaaatttgtcctacatttgtacttgctaaatctggcagccttaattattacacaactataacacaacacaaacagtaatctctcccctagtttagagtcctttgcatgaaatttagcaaatctatcattttgaatacagtacaagcctggtaatccagtgtatttgggataggccagtggaactcagaactgatacatatatacatgtatgtctatcatattcaatgtctattaggtgtaaatcatctcttcatgtaaaagacactactggtttgagggtagactcgtctaggaatattttgtccttctgtgacagcaccactatccatcccaatgtaacatttctacaaagggaagatatcttaaccaggcatacttatatttgctagttggaaaatcattctgaacagttttaattccattctattgaatggattattgtatgagctatttggggatcagatataaatgacaatcacacagaaccacttttattcaacatagataaaatgtgatgagtgttaacattttaaataagcaatctgcttaatggacattggtatgaaggggaagtgtcattctttacctcactcctcaaacacttttctatccaaaggttggtttgagtcagtattggcatcatacaaccacttactgtaaaataagtttattagtggtaacgtgatagaatttattcccgatatctgatgttacaaactttagggtccttgagatatgcaggatccttgtatgtaactggcataaaccctgtaaagagataattaaagttcttgacaaaacataatgagcaaaatttcagctagctcaattcagttgttgaggtattctttcttacccattatttgagctctcttaattgcttttgtgatttctttctgtttcttcccacaaagacctgtaaaataaaaagctttcttattcataaaaaatgtcaatatttaaa

SEQ ID NO: 286640 - DNA, 1922 bp, Homo sapiens
atttagaatttaagcctagatacttcagcagtttttctataactgaacaaagaaacaaagtagctcttgatggtccagtaaaatgagtctaaccagggactccttacaggttttatatatagtaaactacattttcgtggaatatgagaattacgttaaaagagtaccaactaagaataattttattgttcatggaagatagggtaaatctcaatactgccttatttatacatgtactaatcaaaagagccattaaactgtttttccacactattatactaagcacatttcacagctttacatgtcatctgggcccagtgtggtgactcatacctgtaatcccagcactttgggaggccaaggcaggaggatcactgagcaacattaggagacctcatctctacaaaaaacttaaaaattggtcgggtgtggtgatgggtgcctgtagtcccagctacttgggaggctgaggcaagaggattgcttgagcacgggaggttgaagctgcattattgagccatgatcgcaccactgcactgcagcctgggagactgagtgagaccctgtctcaaaaaaaaaaaaaaacagttgtttcaagtcagtaaattctattttggataagtagtaaagaatgggttttggggggtgtatttttttaaatcttgtaggggacaagtaatctattccagcaggtagatactaatctttcttttcattctaagtttatactctaaagttttattttgtcagactttttcacagggtacctttagtggttgccaatctgggcatgtctgaacaactgggttataaaactgtatcaggttcctgtatgtccactggttttagccgagcagtacaaacacacagctctaaattttttgaagaagatggatccttaaaggaggtacataagataaatgaaatgtatgcttcattacaagaggaattaaagagtatatgcaaaaaagtggaagacagtgaacaagcagtagataaactagtaaaggatgtaaacagattaaaacgagaaattgagaaaaggagaggagcacagattcaggcagcaagagagaagaacatccaaaaagaccctcaggagaacatttttctttgtcaggcattacggaccttttttccaaattctgaatttcttcattcatgtgttatgtctttaaaaaatagacatgtttctaaaagtagctgtaactacaaccaccatctcgatgtagtagacaatctgaccttaatggtagaacacactgacattcctgaagctagtccagctagtacaccacaaatcattaagcataaagccttagacttagatgacagatggcaattcaagagatctcggttgttagatacacaagacaaacgatctaaagcagatactggtagtagtaaccaagataaagcatccaaaatgagcagcccagaaacagatgaagaaattgaaaagatgaagggttttggtgaatattcacggtctcctacattttgatccttttaaccttacaaggagatttttttatttggctgatgggtaaagccaaacatttctattgtttttactatgttgagctacttgcagtaagttcatttgtttttactatgttcacctgtttgcagtaatacacagataactcttagtgcatttacttcacaaagtactttttcaaacatcagatgcttttatttccaaacctttttttcacctttcactaagttgttgaggggaaggcttacacagacacattctttagaattggaaaagtgagaccaggcacagtggctcacacctgtaatcccagcacttagggaagacaagtcaggaggattgattgaagctaggagttagagaccagcctgggcaacgtattgagacgggcgtagacttcaccagtacgggatgttaatca

SEQ ID NO: 286641 - DNA, 1114 bp, Homo sapiens
cgtgcgccggcgcaggccccgcctcctcgctgggccccgcctcgctgccaccacagggtcttgcctccgcgcgccccgccctcgtcctcttgtgtagcctgaggcggcggtagcatggagggggagagtacgtcggcggtgctctcgggctttgtgctcggcgcactcgctttccagcacctcaacacggactcggacacggaaggttttcttcttggggaagtaaaaggtgaagccaagaacagcattactgattcccaaatggatgatgttgaagttgtttatacaattgacattcagaaatatattccatgctatcagctttttagcttttataattcttcaggcgaagtaaatgagcaagcactgaagaaaatattatcaaatgtcaaaaagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacattccttatataaacctcaaaaaggactttttcacagggtacctttagtggttgccaatctgggcatgtctgaacaactgggttataaaactgtatcaggttcctgtatgtccactggttttagccgagcagtacaaacacacagctctaaattttttgaagaagatggatccttaaaggaggtacataagataaatgaaatgtatgcttcattacaagaggaattaaagctctactccttttctgaatgtcatcttcatccaggatccaggctgaaggagcagcccttatttgggacatgtcctcatggcataaggcaaagagcaagaaagctagtggattacaggcgtgagccaccgcagctggcccatgagttaatatttcagtttatttctgtatattttcagcgaactaactggcatgataaaagctgtataaatgagaagttacatgtgaaaaagcattttacaacctataaggcttatttataacctacaagtgcttgttactgacatcctccagaaaataaataaaatttatataaaaggc

SEQ ID NO: 286642 - DNA, 397 bp, Homo sapiens
aaaaaaaaaagaaaaaaaaaaaactcttgtgtagcctgaggcggcggtagcatggagggggagagtacgtcggcggtgctctcgggctttgtgctcggcgcactcgctttccagcacctcaacacggactcggacacgggtcgggcgcggtggctcacgcctgtaattccagccctttgggaagccgaggcgggtgaatcacctgagcccacgagttcgagaccatcggggacaacgtagtgagacccggtctctacaaaatctaaacattacaaaattgctctttggcacaatcctaataaaggttggaattggtatgttttatgtatacaatttcagataaccttacaaagtaatacctaataaagaacaaatatatgaccatttaaaatatatg

SEQ ID NO: 286643 - DNA, 2758 bp, Homo sapiens
aaaaaaaaaagaaaaaaaaaaaactcttgtgtagcctgaggcggcggtagcatggagggggagagtacgtcggcggtgctctcgggctttgtgctcggcgcactcgctttccagcacctcaacacggactcggacacggaaggttttcttcttggggaagtaaaaggtgaagccaagaacagcattactgattcccaaatggatgatgttgaagttgtttatacaattgacattcagaaatatattccatgctatcagctttttagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacattccttatataaacctcaaaaaggactttttcacagggtacctttagtggttgccaatctgggcatgtctgaacaactgggttataaaactgtatcaggttcctgtatgtccactggttttagccgagcagtacaaacacacagctctaaattttttgaagaagatggatccttaaaggaggtacataagataaatgaaatgtatgcttcattacaagaggaattaaagagtatatgcaaaaaagtggaagacagtgaacaagcagtagataaactagtaaaggatgtaaacagattaaaacgagaaattgagaaaaggagaggagcacagattcaggcagcaagagagaagaacatccaaaaagaccctcaggagaacatttttctttgtcaggcattacggaccttttttccaaattctgaatttcttcattcatgtgttatgtctttaaaaaatagacatgtttctaaaagtagctgtaactacaaccaccatctcgatgtagtagacaatctgaccttaatggtagaacacactgacattcctgaagctagtccagctagtacaccacaaatcattaagcataaagccttagacttagatgacagatggcaattcaagagatctcggttgttagatacacaagacaaacgatctaaagcagatactggtagtagtaaccaagataaagcatccaaaatgagcagcccagaaacagatgaagaaattgaaaagatgaagggttttggtgaatattcacggtctcctacattttgatccttttaaccttacaaggagatttttttatttggctgatgggtaaagccaaacatttctattgtttttactatgttgagctacttgcagtaagttcatttgtttttactatgttcacctgtttgcagtaatacacagataactcttagtgcatttacttcacaaagtactttttcaaacatcagatgcttttatttccaaacctttttttcacctttcactaagttgttgaggggaaggcttacacagacacattctttagaattggaaaagtgagaccaggcacagtggctcacacctgtaatcccagcacttagggaagacaagtcaggaggattgattgaagctaggagttagagaccagcctgggcaacgtattgagaccatgtctattaaaaaataaaatggaaaagcaagaatagccttattttcaaaatatggaaagaaatttatatgaaaatttatctgagtcattaaaattctccttaagtgatacttttttagaagtacattatggctagagttgccagataaaatgctggatatcatgcaataaatttgcaaaacatcatctaaaatttaaatttgtcctacatttgtacttgctaaatctggcagccttaattattacacaactataacacaacacaaacagtaatctctcccctagtttagagtcctttgcatgaaatttagcaaatctatcattttgaatacagtacaagcctggtaatccagtgtatttgggataggccagtggaactcagaactgatacatatatacatgtatgtctatcatattcaatgtctattaggtgtaaatcatctcttcatgtaaaagacactactggtttgagggtagactcgtctaggaatattttgtccttctgtgacagcaccactatccatcccaatgtaacatttctacaaagggaagatatcttaaccaggcatacttatatttgctagttggaaaatcattctgaacagttttaattccattctattgaatggattattgtatgagctatttggggatcagatataaatgacaatcacacagaaccacttttattcaacatagataaaatgtgatgagtgttaacattttaaataagcaatctgcttaatggacattggtatgaaggggaagtgtcattctttacctcactcctcaaacacttttctatccaaaggttggtttgagtcagtattggcatcatacaaccacttactgtaaaataagtttattagtggtaacgtgatagaatttattcccgatatctgatgttacaaactttagggtccttgagatatgcaggatccttgtatgtaactggcataaaccctgtaaagagataattaaagttcttgacaaaacataatgagcaaaatttcagctagctcaattcagttgttgaggtattctttcttacccattatttgagctctcttaattgcttttgtgatttctttctgtttcttcccacaaagacctgtaaaataaaaagctttcttattcataaaaaatgtcaatatttaaa

SEQ ID NO: 286644 - DNA, 3072 bp, Homo sapiens
cgtgcgccggcgcaggccccgcctcctcgctgggccccgcctcgctgccaccacagggtcttgcctccgcgcgccccgccctcgtcctcttgtgtagcctgaggcggcggtagcatggagggggagagtacgtcggcggtgctctcgggctttgtgctcggcgcactcgctttccagcacctcaacacggactcggacacgggtcgggcgcggtggctcacgcctgtaattccagccctttgggaagccgaggcgggtgaatcacctgagcccacgagttcgagaccatcggggacaacgtagtgagacccggtctctacaaaatctaaacattacaaaattgctctttggcacaatcctaataaaggttggaattggtatgttttaaggttttcttcttggggaagtaaaaggtgaagccaagaacagcattactgattcccaaatggatgatgttgaagttgtttatacaattgacattcagaaatatattccatgctatcagctttttagcttttataattcttcaggcgaagtaaatgagcaagcactgaagaaaatattatcaaatgtcaaaaagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacattccttatataaacctcaaaaaggactttttcacagggtacctttagtggttgccaatctgggcatgtctgaacaactgggttataaaactgtatcaggttcctgtatgtccactggttttagccgagcagtacaaacacacagctctaaattttttgaagaagatggatccttaaaggaggtacataagataaatgaaatgtatgcttcattacaagaggaattaaagagtatatgcaaaaaagtggaagacagtgaacaagcagtagataaactagtaaaggatgtaaacagattaaaacgagaaattgagaaaaggagaggagcacagattcaggcagcaagagagaagaacatccaaaaagaccctcaggagaacatttttctttgtcaggcattacggaccttttttccaaattctgaatttcttcattcatgtgttatgtctttaaaaaatagacatgtttctaaaagtagctgtaactacaaccaccatctcgatgtagtagacaatctgaccttaatggtagaacacactgacattcctgaagctagtccagctagtacaccacaaatcattaagcataaagccttagacttagatgacagatggcaattcaagagatctcggttgttagatacacaagacaaacgatctaaagcagatactggtagtagtaaccaagataaagcatccaaaatgagcagcccagaaacagatgaagaaattgaaaagatgaagggttttggtgaatattcacggtctcctacattttgatccttttaaccttacaaggagatttttttatttggctgatgggtaaagccaaacatttctattgtttttactatgttgagctacttgcagtaagttcatttgtttttactatgttcacctgtttgcagtaatacacagataactcttagtgcatttacttcacaaagtactttttcaaacatcagatgcttttatttccaaacctttttttcacctttcactaagttgttgaggggaaggcttacacagacacattctttagaattggaaaagtgagaccaggcacagtggctcacacctgtaatcccagcacttagggaagacaagtcaggaggattgattgaagctaggagttagagaccagcctgggcaacgtattgagaccatgtctattaaaaaataaaatggaaaagcaagaatagccttattttcaaaatatggaaagaaatttatatgaaaatttatctgagtcattaaaattctccttaagtgatacttttttagaagtacattatggctagagttgccagataaaatgctggatatcatgcaataaatttgcaaaacatcatctaaaatttaaatttgtcctacatttgtacttgctaaatctggcagccttaattattacacaactataacacaacacaaacagtaatctctcccctagtttagagtcctttgcatgaaatttagcaaatctatcattttgaatacagtacaagcctggtaatccagtgtatttgggataggccagtggaactcagaactgatacatatatacatgtatgtctatcatattcaatgtctattaggtgtaaatcatctcttcatgtaaaagacactactggtttgagggtagactcgtctaggaatattttgtccttctgtgacagcaccactatccatcccaatgtaacatttctacaaagggaagatatcttaaccaggcatacttatatttgctagttggaaaatcattctgaacagttttaattccattctattgaatggattattgtatgagctatttggggatcagatataaatgacaatcacacagaaccacttttattcaacatagataaaatgtgatgagtgttaacattttaaataagcaatctgcttaatggacattggtatgaaggggaagtgtcattctttacctcactcctcaaacacttttctatccaaaggttggtttgagtcagtattggcatcatacaaccacttactgtaaaataagtttattagtggtaacgtgatagaatttattcccgatatctgatgttacaaactttagggtccttgagatatgcaggatccttgtatgtaactggcataaaccctgtaaagagataattaaagttcttgacaaaacataatgagcaaaatttcagctagctcaattcagttgttgaggtattctttcttacccattatttgagctctcttaattgcttttgtgatttctttctgtttcttcccacaaagacctgtaaaataaaaagctttcttattcataaaaaatgtcaatatttaaa

SEQ ID NO: 286645 - DNA, 778 bp, Homo sapiens
gattcattttaagcaacgggcggcctccgcctccattgaaggcggggaaataccgcggcgcggacggtagttgctgtggtttccgttctgagctcgcagcttaggagctgaagatcgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaaggtaggttgccacctctgttctcccagagacatcatatactagggaggcagtacgtcatagaggttaatagcacagactgcggagtcagagtgccggatgtgagtctatctctgccacttagagcttaccatgggcaagttactgaatcccccagaccttagcatactcatctgtacaatgggcagaataatagtacattttccttatagggttattgcgaggagtaaataaatgaatatatataaaacacgtaaagccttgcttagcacatagtaagcacgatgtcagtattagctatattattaaccaaagtg

SEQ ID NO: 286646 - DNA, 1282 bp, Homo sapiens
atccttaattaaattaatcccccccccccccgggtagttgctgtggtttccgttctgagctcgcagcttaggagctgaagatcgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttcctttccttgtcatgattatcaaaaacctgaagaagtattttaccttcgaagtgcaggtactagatgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcagatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgtgactcttctttttaaaaggaaactatgtggaggacgatgcaaaaacatatttatcttagtttgctctgctgtagttctgttatttatacttggtgttgcttgtcatggacaccggtgaacatgccgtaactctgtgactgcattgtaagtgcagtgggggtaagcagtcctgtgagtggcgcatgaacgctggagcttattccgccgcctgccccagtgtggggggagatacctttaccatgaacttacagaattaaagatggcccataaggaattccagaccaatatttcttcctgcggtttattctatgttttatatattatctaaatatatgtatatgctgtgtcatactcataatctggaaatgaataaagtgatatattcctggtttgtaaa

SEQ ID NO: 286647 - DNA, 1438 bp, Homo sapiens
gattcattttaagcaacgggcggcctccgcctccattgaaggcggggaaataccgcggcgcggacggtagttgctgtggtttccgttctgagctcgcagcttaggagctgaagatcgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttcctttccttgtcatgattatcaaaaacctgaagaagtattttaccttcgaagtgcaggtactagatgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcagatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgtgactcttctttttaaaaggaaactatgtggaggacgatgcaaaaacatatttatcttagtttgctctgctgtagttctgttatttatacttggtgttgcttgtcatggacaccggtgaacatgccgtaactctgtgactgcattgtaagtgcagtgggggtaagcagtcctgtgagtggcgcatgaacgctggagcttattccgccgcctgccccagtgtggggggagatacctttaccatgaacttacagaattaaagatggcccataaggaattccagaccaatatttcttcctgcggtttattctatgttttatatattatctaaatatatgtatatgctgtgtcatactcataatctggaaatgaataaagtgatatattcctggtttgtaaaaaaaaaaaaaaaatttgctataaaatgagaagtctcactgatagaggttctttattgctcattttttaaaaaatggactcttgaaatctgttaaaataaaattgtacatttggaaaaaaaaaa

SEQ ID NO: 286648 - DNA, 1453 bp, Homo sapiens
gattcattttaagcaacgggcggcctccgcctccattgaaggcggggaaataccgcggcgcggacggtagttgctgtggtttccgttctgagctcgcagcttaggagctgaagatcgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttcctttccttgtcatgattatcaaaaacctgaagaagtattttaccttcgaagtgcaggtactagatgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcagaatccatccctaagacaagccaaggagatgccggagatgacgcgtttccagtcctggaagagggcctctagaagattcaggaaaagggggagaacagtcacatttcgcctctcaaaagaagcattgccttgacagatcatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgtgactcttctttttaaaaggaaactatgtggaggacgatgcaaaaacatatttatcttagtttgctctgctgtagttctgttatttatacttggtgttgcttgtcatggacaccggtgaacatgccgtaactctgtgactgcattgtaagtgcagtgggggtaagcagtcctgtgagtggcgcatgaacgctggagcttattccgccgcctgccccagtgtggggggagatacctttaccatgaacttacagaattaaagatggcccataaggaattccagaccaatatttcttcctgcggtttattctatgttttatatattatctaaatatatgtatatgctgtgtcatactcataatctggaaatgaataaagtgatatattcctggtttgtaaa

SEQ ID NO: 286649 - DNA, 1792 bp, Homo sapiens
gattcattttaagcaacgggcggcctccgcctccattgaaggcggggaaataccgcggcgcggacggtagttgctgtggtttccgttctgagctcgcagcttaggagctgaagatcgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttcctttccttgtcatgattatcaaaaacctgaagaagtattttaccttcgaagtgcaggtactagatgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcagcaggtactgctcctttcccagatagagccctgggttggggatagggcacactgcgtctaatattggcttgtggcccacatagcagaacagtgtgggtttctggcttcagttgccacactgtccagggagctttggcctcacaaaggtccaggaaatattcagaagtcgggtcaggtatagaggtgaatacagcaagtaagacctccctcttgccagaatccatccctaagacaagccaaggagatgccggagatgacgcgtttccagtcctggaagagggcctctagaagattcaggaaaagggggagaacagtcacatttcgcctctcaaaagaagcattgccttgacagatcatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgtgactcttctttttaaaaggaaactatgtggaggacgatgcaaaaacatatttatcttagtttgctctgctgtagttctgttatttatacttggtgttgcttgtcatggacaccggtgaacatgccgtaactctgtgactgcattgtaagtgcagtgggggtaagcagtcctgtgagtggcgcatgaacgctggagcttattccgccgcctgccccagtgtggggggagatacctttaccatgaacttacagaattaaagatggcccataaggaattccagaccaatatttcttcctgcggtttattctatgttttatatattatctaaatatatgtatatgctgtgtcatactcataatctggaaatgaataaagtgatatattcctggtttgtaaaaaaaaaaaaaaaatttgctataaaatgagaagtctcactgatagaggttctttattgctcattttttaaaaaatggactcttgaaatctgttaaaataaaattgtacatttggaaaaaaaaaa

SEQ ID NO: 286650 - DNA, 589 bp, Homo sapiens
gcggccgcctactagtactaaattcgcggccgcgtcgacatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgtgactcttctttttaaaaggaaactatgtggaggacgatgcaaaaacatatttatcttagtttgctctgctgtagttctgttatttatacttggtgttgcttgtcatggacaccggtgaacatgccgtaactctgtgactgcattgtaagtgcagtgggggtaagcagtcctgtgagtggcgcatgaacgctggagcttattccgccgcctgccccagtgtggggggagatacctttaccatgaacttacagaattaaagatggcccataaggaattccagaccaatatttcttcctgcggtttattctatgttttatatattatctaaatatatgtatatgctgtgtcatactcataatctggaaatgaataaagtgatatattcctggtttgtaaa

SEQ ID NO: 286651 - DNA, 860 bp, Homo sapiens
gattcattttaagcaacgggcggcctccgcctccattgaaggcggggaaataccgcggcgcggacggtagttgctgtggtttccgttctgagctcgcagcttaggagctgaagatcgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttcctttccttgtcatgattatcaaaaacctgaagaagtattttaccttcgaagtgcaggtaagtatgtgtacatgaatgtgtccactcttggctataccaaagtgatagcctttgaactgatgggaaaaagtgaccctacaaagtatctttatccttttgcatgtattcttttctgcttctagtataagcccagtgcagtccttgttatgtaaatttgatattagtaataaaatttaatcaggtttttaaagaaacagcacctagaaaacctagtaatttcaaagtgtcagagttagcgtggtatccatttggggagtgattatttaatagtgggtggctgt

SEQ ID NO: 286652 - DNA, 1315 bp, Homo sapiens
gattcattttaagcaacgggcggcctccgcctccattgaaggcggggaaataccgcggcgcggacggtagttgctgtggtttccgttctgagctcgcagcttaggagctgaagatcgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttcctttccttgtcatgattatcaaaaacctgaagaagtattttaccttcgaagtgcaggtactagatgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcagatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgtgactcttctttttaaaaggaaactatgtggaggacgatgcaaaaacatatttatcttagtttgctctgctgtagttctgttatttatacttggtgttgcttgtcatggacaccggtgaacatgccgtaactctgtgactgcattgtaagtgcagtgggggtaagcagtcctgtgagtggcgcatgaacgctggagcttattccgccgcctgccccagtgtggggggagatacctttaccatgaacttacagaattaaagatggcccataaggaattccagaccaatatttcttcctgcggtttattctatgttttatatattatctaaatatatgtatatgctgtgtcatactcataatctggaaatgaataaagtgatatattcctggtttgtaaa

SEQ ID NO: 286653 - DNA, 1678 bp, Homo sapiens
gattcattttaagcaacgggcggcctccgcctccattgaaggcggggaaataccgcggcgcggacggtagttgctgtggtttccgttctgagctcgcagcttaggagctgaagatcgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttcctttccttgtcatgattatcaaaaacctgaagaagtattttaccttcgaagtgcaggtactagatgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcagatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgtgactcttctttttaaaaggaaactatgtggaggacgatgcaaaaacatatttatcttagtttgctctgctgtagttctgttatttatacttggtgttgcttgtcatggacaccggtgaacatgccgtaactctgtgactgcattgtaagtgcagtgggggtaagcagtcctgtgagtggcgcatgaacgctggagcttattccgccgcctgccccagtgtggggggagatacctttaccatgaacttacagaattaaagatggcccataaggaattccagaccaatatttcttcctgcggtttattctatgttttatatattatctaaatatatgtatatgctgtgtcatactcataatctggaaatgaataaagtgatatattcctggtttgtaaaaaaaaaaaaaaaaaaaaaaaaaaaaaaaaagggggggggccactgaacccgggagaaaaacttcacaaaacaacaggagaagggggcgcgggtgcccaaaaagaggaaagagggacaacgagtggccaaaagaagacaacccaaaaggaagaaccggggacaaaagaaacaagcagcaaggacatccaagacacccaaaaacaaacgaccacggagggaaacaaggcagaaagactagagagaaaaaaaacactccaagaagtgggaaatcagaaaaggcaaaaaaaaagagagaaatataaacaaagaggagaacccaaaggaaaaccacaaaactacaaaaataagccccgagacagggag

SEQ ID NO: 286654 - DNA, 1669 bp, Homo sapiens
gattcattttaagcaacgggcggcctccgcctccattgaaggcggggaaataccgcggcgcggacggtagttgctgtggtttccgttctgagctcgcagcttaggagctgaagatcgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttcctttccttgtcatgattatcaaaaacctgaagaagtattttaccttcgaagtgcaggtactagatgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcagcaggtactgctcctttcccagatagagccctgggttggggatagggcacactgcgtctaatattggcttgtggcccacatagcagaacagtgtgggtttctggcttcagttgccacactgtccagggagctttggcctcacaaaggtccaggaaatattcagaagtcgggtcaggtatagaggtgaatacagcaagtaagacctccctcttgccagaatccatccctaagacaagccaaggagatgccggagatgacgcgtttccagtcctggaagagggcctctagaagattcaggaaaagggggagaacagtcacatttcgcctctcaaaagaagcattgccttgacagatcatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgtgactcttctttttaaaaggaaactatgtggaggacgatgcaaaaacatatttatcttagtttgctctgctgtagttctgttatttatacttggtgttgcttgtcatggacaccggtgaacatgccgtaactctgtgactgcattgtaagtgcagtgggggtaagcagtcctgtgagtggcgcatgaacgctggagcttattccgccgcctgccccagtgtggggggagatacctttaccatgaacttacagaattaaagatggcccataaggaattccagaccaatatttcttcctgcggtttattctatgttttatatattatctaaatatatgtatatgctgtgtcatactcataatctggaaatgaataaagtgatatattcctggtttgtaaa

SEQ ID NO: 286655 - DNA, 1302 bp, Homo sapiens
  misc_feature (119)..(119): n is a, c, g, or t
aggaagcttaggtaagcagcaatactgtgcggactctacgcgttgcacgtgatgctagagtgacggatgatccaagtaggctgtagacttacggaggatccatgggatctactgacctnagctcgcttctgtcagtgcataccagcggaactgagacatagatgcgctgtgcgcgctcagcaggacgtcggtgctgcgcataggtaatcttcacatcactgggagtccttaggtcgtcgatccagtgggggatcgtatctaacgaggaaggccgaccggagcatcatgtactaaaattacgctcccaacacggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttcctttccttgtcatgattatcaaaaacctgaagaagtattttaccttcgaagtgcaggtactagatgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcagatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgtgactcttctttttaaaaggaaactatgtggaggacgatgcaaaaacatatttatcttagtttgctctgctgtagttctgttatttatacttggtgttgcttgtcatggacaccggtgaacatgccgtaactctgtgactgcattgtaagtgcagtgggggtaagcagtcctgtgagtggcgcatgaacgctggagcttattccgccgcctgccccagtgtggggggagatacctttaccatgaacttacagaattaaagatggcccataaggaattccagaccaatatttcttcctgcggtttattctatgttttatatattatctaaatatatgtatatgctgtgtcatactcataatctggaaatgaataaagtgatatattcctggtttgtaaa

SEQ ID NO: 286656 - DNA, 849 bp, Homo sapiens
gtctcagccttgggaaagcaagctgtgggaattcaggtccttgtctggacaaggttgtgtgcttcttccaagacagagctagtgtgatgcttcttctctgtatttcacaggtactagatgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcagatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgtgactcttctttttaaaaggaaactatgtggaggacgatgcaaaaacatatttatcttagtttgctctgctgtagttctgttatttatacttggtgttgcttgtcatggacaccggtgaacatgccgtaactctgtgactgcattgtaagtgcagtgggggtaagcagtcctgtgagtggcgcatgaacgctggagcttattccgccgcctgccccagtgtggggggagatacctttaccatgaacttacagaattaaagatggcccataaggaattccagaccaatatttcttcctgcggtttattctatgttttatatattatctaaatatatgtatatgctgtgtcatactcataatctggaaatgaataaagtgatatattcctggtttgtaaa

SEQ ID NO: 286657 - DNA, 308 bp, Homo sapiens
gccagctcagtgtggatcagagcaaggctaggacagaccaggcagcagtcatggagaagggtagagcagagaatgcattactacaggactcagagaagaagaggagtcattcttctccatcacagattcctaaaaagattctcagtcacatgacccatgaagtaacagaggatttttctcctcgggatccaagaactgttgttgggaagcaagatggcaggggctgcacttcagtcacaacagcattgtccctacctgaactggaaagggaagatggaaaagaagacatttcagatcctatggacccg

SEQ ID NO: 286658 - DNA, 853 bp, Homo sapiens
agaaatcttacaggcaaaggctattcgacatttgggattcctaagctaatctttttatttttggaagggtgtctttctgagaaaggcagccagaggcacagcaccaacctttctgacagtgtggtcttcacactgttagttctgacaaagggagtcaaggagtcgtccttggaggaggcgatgaggccagtggaagaattgtggctggggacccctccactgctgagggagatgtcgatggactcacagctggtgtggaggctgctgacagactgaaagcccaggccatccttgctaactgcggaggagctgctggcgttggtgccccagggccaagacagccccggcctcttaccagttcctggggtcttcagtgcgcctgccggggctgaagccttcgtccttggcatggtgatgcccacctgagctgtcatgcctcgccgccatgagcctgtctgggagatgacaggattcttcttgcccgacgtgcttttgtcggactcgtcagacacatcagaaggattccgcctccacttggaacctggctccatttttatgccgctgtctgagcctccgtctgatttcttgacatcatcaccagaccacagggaattcctctccacctgtgagtgcttctcagcatcagtctgtggacagagactctctgaattagtccttccccagtcccaggctgggaagcccctcactccaaaggcaaaaatgccaaaacactggagtagttaagggaaaaataagcattactttaaagatgtttggacttttgtactctggttatcttgttagaaagactgattttttttttttggaaaaaaaaataaaaaagtaaataata

SEQ ID NO: 286659 - DNA, 1371 bp, Homo sapiens
  misc_feature (1086)..(1086): n is a, c, g, or t
  misc_feature (1139)..(1139): n is a, c, g, or t
  misc_feature (1149)..(1149): n is a, c, g, or t
  misc_feature (1159)..(1159): n is a, c, g, or t
  misc_feature (1165)..(1165): n is a, c, g, or t
  misc_feature (1175)..(1175): n is a, c, g, or t
  misc_feature (1288)..(1288): n is a, c, g, or t
  misc_feature (1292)..(1292): n is a, c, g, or t
ttccactcccacccgcccagctcgcgccacatacagtccctcaacgcgctcctgccgcgccgccccctccagacagcagcgttccggatcctagacgctttttgacggctggtcctccccagaaaatgcgccgtgtgagcccaaacatggtggggtttacgctggaccccgagcttgcaatctgtgcttgacaaaacacaaacatcgcgtgcctgtctcctccccctgagatcgagtagtaacagccactccaactctccacctccagcttctagcaccagggaccgcctccaccaccccatgtgccaagtggagttcgagctgcgcggccctcaagcagctgaagggtcccgtgagcgatcaggagaagctgctggtctacggcttgtacaaacaggccacccagggcgactgcgacatccccggccctccggcctcagacatcatgacatcaggtcagctgcagttctcactgggaccaataaacaatagaagcaacaaccataaagacttaagaggacaaaggaaaccaaacctcactgtgtgtcttcaagatctgttcacatagttgcaggaagttgctgtagacaaagtacattactaaagaatgaagcccacccaggacatcacagcaacgaaagaactatttctggtaactgtggaccaggtgagagccacactgtagaacagcagtgctgccctctcttctttggcgaatgttatgaagacattctgatgcacttaggatcatgattcatgttaaatgtaaattaattgtaaaaataatacatcttgctccaaaatgtggtgacaatttagaagctgtccacatagccagaccactctgtaaatcacagaacctagaaagtaaaaatgtgccataattaggacagcagaaagtaacagtaaaataaagttttaaaaaaaaaaacagaaaataaggatttatctatttgtatttgcttaagaagaggttacctataggatgcagggggaatgggattgatgggcatggggtatactgtgaaaggaaaataaaatcttgggaccaaattcactaagcgaaaaggaaaagttaagcttggnaattgagtcatggaatatgcaaaaaacttccttttgttcctaaacagataagntacaagacanaaggccacanatctcnccaggtggtntccctcacctgacaatataaattaacagcttatcttcataggtaagggacaaagacaacaccagaaaccatccctcaccagccgagacaaaacatagatgtactgagctgaangcanaactgttcctctgcctgctgctttcactgtaacatatagatttggtgagcagtaaatgtagatttactgagctgaatgc

SEQ ID NO: 286660 - DNA, 1013 bp, Homo sapiens
  misc_feature (728)..(728): n is a, c, g, or t
  misc_feature (781)..(781): n is a, c, g, or t
  misc_feature (791)..(791): n is a, c, g, or t
  misc_feature (801)..(801): n is a, c, g, or t
  misc_feature (807)..(807): n is a, c, g, or t
  misc_feature (817)..(817): n is a, c, g, or t
  misc_feature (930)..(930): n is a, c, g, or t
  misc_feature (934)..(934): n is a, c, g, or t
ccgccgcgcacgcgcagtcctcacgaacgagcgcgccaagcgcacagcgccgccttccggcagagccctcccaccagccctcagatcatgacatcaggtcagctgcagttctcactgggaccaataaacaatagaagcaacaaccataaagacttaagaggacaaaggaaaccaaacctcactgtgtgtcttcaagatctgttcacatagttgcaggaagttgctgtagacaaagtacattactaaagaatgaagcccacccaggacatcacagcaacgaaagaactatttctggtaactgtggaccaggtgagagccacactgtagaacagcagtgctgccctctcttctttggcgaatgttatgaagacattctgatgcacttaggatcatgattcatgttaaatgtaaattaattgtaaaaataatacatcttgctccaaaatgtggtgacaatttagaagctgtccacatagccagaccactctgtaaatcacagaacctagaaagtaaaaatgtgccataattaggacagcagaaagtaacagtaaaataaagttttaaaaaaaaaaacagaaaataaggatttatctatttgtatttgcttaagaagaggttacctataggatgcagggggaatgggattgatgggcatggggtatactgtgaaaggaaaataaaatcttgggaccaaattcactaagcgaaaaggaaaagttaagcttggnaattgagtcatggaatatgcaaaaaacttccttttgttcctaaacagataagntacaagacanaaggccacanatctcnccaggtggtntccctcacctgacaatataaattaacagcttatcttcataggtaagggacaaagacaacaccagaaaccatccctcaccagccgagacaaaacatagatgtactgagctgaangcanaactgttcctctgcctgctgctttcactgtaacatatagatttggtgagcagtaaatgtagatttactgagctgaatgc

SEQ ID NO: 286661 - DNA, 1970 bp, Homo sapiens
  misc_feature (1685)..(1685): n is a, c, g, or t
  misc_feature (1738)..(1738): n is a, c, g, or t
  misc_feature (1748)..(1748): n is a, c, g, or t
  misc_feature (1758)..(1758): n is a, c, g, or t
  misc_feature (1764)..(1764): n is a, c, g, or t
  misc_feature (1774)..(1774): n is a, c, g, or t
  misc_feature (1887)..(1887): n is a, c, g, or t
  misc_feature (1891)..(1891): n is a, c, g, or t
tttggaggatgggggaactcatctaaggcaggcaggtacttatgggccattgcactaaactgggagagcagggggtcctgcgggtgacccttgtgcttcatcacctcccaccagacgtccaggaagaaggccacgtcttcggcagaagtgtcaacggtcacatgttccagaaagcgctctagttctgcatggcagatggtggtgggcagggccatcaggagctggataaagagtccagaagcttccagggatttgagcagctcgaagaggatggtgtggttgatggtggggatcatgttgcccaccgagaagaacaggtcttcctgccaccgtgtctctgtgtcggacggggtcacggggtgcggctgcagaaccttggcccagatgatgatcagggctttcttcttccaggcaaagggctgggagtgtgctgcagccgaggagatctcccttaaggcctccacgatgggccgtccaacacgttcccagtcagactttgttaattctgccagtgccttagggtggaacagctgctcggccagcaagaagcctccatgcagaatagtcatttcttcacagatgttcaagggtcccggttcatgttttgagggagaccaagctttccgtgatgataatgtgatgaaacaattgatgcgccagaacacagcagtttagaaacaatggagcagatggtgtcaaaatcccagccccagaaaggctcacctaaggccgggcaaccaaaatgttcccgggactattctgtacttaaccctggtttctgcttaggggacggtgggacaatatgcatatggatgtctatgtgggatttgttgcaagagcacaacacaccccttgacctatgcaagtgccagagtgtctgagcccagcttctactcctgttaatgatcacaggagcctcatacacaaccattgtgcatggcggctggagtatggagtagtaaatggtatccagaaaggcaggtctacggtggcatatgggatttcctggtacttcttctttaatagaaactatcttcacagatcatgacatcaggtcagctgcagttctcactgggaccaataaacaatagaagcaacaaccataaagacttaagaggacaaaggaaaccaaacctcactgtgtgtcttcaagatctgttcacatagttgcaggaagttgctgtagacaaagtacattactaaagaatgaagcccacccaggacatcacagcaacgaaagaactatttctggtaactgtggaccaggtgagagccacactgtagaacagcagtgctgccctctcttctttggcgaatgttatgaagacattctgatgcacttaggatcatgattcatgttaaatgtaaattaattgtaaaaataatacatcttgctccaaaatgtggtgacaatttagaagctgtccacatagccagaccactctgtaaatcacagaacctagaaagtaaaaatgtgccataattaggacagcagaaagtaacagtaaaataaagttttaaaaaaaaaaacagaaaataaggatttatctatttgtatttgcttaagaagaggttacctataggatgcagggggaatgggattgatgggcatggggtatactgtgaaaggaaaataaaatcttgggaccaaattcactaagcgaaaaggaaaagttaagcttggnaattgagtcatggaatatgcaaaaaacttccttttgttcctaaacagataagntacaagacanaaggccacanatctcnccaggtggtntccctcacctgacaatataaattaacagcttatcttcataggtaagggacaaagacaacaccagaaaccatccctcaccagccgagacaaaacatagatgtactgagctgaangcanaactgttcctctgcctgctgctttcactgtaacatatagatttggtgagcagtaaatgtagatttactgagctgaatgc

SEQ ID NO: 286662 - DNA, 2753 bp, Homo sapiens
  misc_feature (2468)..(2468): n is a, c, g, or t
  misc_feature (2521)..(2521): n is a, c, g, or t
  misc_feature (2531)..(2531): n is a, c, g, or t
  misc_feature (2541)..(2541): n is a, c, g, or t
  misc_feature (2547)..(2547): n is a, c, g, or t
  misc_feature (2557)..(2557): n is a, c, g, or t
  misc_feature (2670)..(2670): n is a, c, g, or t
  misc_feature (2674)..(2674): n is a, c, g, or t
ttccactcccacccgcccagctcgcgccacatacagtccctcaacgcgctcctgccgcgccgccccctccagacagcagcgttccggatcctagacgctttttgacggctggtcctccccagaaaatgcgccgtgtgagcccaaacatggtggggtttacgctggaccccgagcttgcaatctgtgcttgacaaaacacaaacatcgcgtgcctgtctcctccccctgagatcgagtagtaacagccactccaactctccacctccagcttctagcaccagggaccgcctccaccaccccatgtgccaagtggagttcgagctgcgcggccctcaagcagctgaagggtcccgtgagcgatcaggagaagctgctggtctacggcttgtacaaacaggccacccagggcgactgcgacatccccggccctccggcctcagacgtgagagccagggccaagtgggaggcttggagcgcgaaaaaaggggcgtccaagatggacgccatgaggggctacgcggccaaagtggaggagctgacgaagaaggaagtggggggcgtggagcgcgaacaaaggggcgtgcaagatggacgccatgaggggctacgcggccaaagtggaggagctgacgaagaaggaagtggggggcgtggagcgcgaacaaaggggcgtccaagatggacgccatgaggggctacgcggccaaagtggaggagctgacgaagaaggaagtggggggcgtggagcgcgaacaaaggggcgtccaagatggacgccatgaggggctacgcggccaaagtggaggagctgacgaagaaggaagtggggggcgtggagcgcgaacaaaggggcgtccaagatggacgccatgaggggctacgcggccagagtgaggagatgaggaagaaggaggctggctgagggctcctcgggaatggaaagggcttcttagaccttgatggctgaaatgtcctgaaactgtcgcaagcttagccgagacatcaataaatcacttaaactgcatgagagtgactgctgttggaaaggagaaactcggtgactgagtgctggggaggcgtccaaatacacagactaactttttgtatggttttgggtggagttcccagctctcctattacaagagcgtatgtaggtatttggaaggacgagggggacagtgtgctgtggaaatgcccaagatctgagggcaggagaccattctccagtgacagcctcttgggaggttgaggccccagccccttatctcttcaaggctgatttactaataccccagcaccacagaggggagagggactctgtcctcctaaacactaaagtcaagtccaaaagcccccactggaacacagggcctacccggttcatgttttgagggagaccaagctttccgtgatgataatgtgatgaaacaattgatgcgccagaacacagcagtttagaaacaatggagcagatggtgtcaaaatcccagccccagaaaggctcacctaaggccgggcaaccaaaatgttcccgggactattctgtacttaaccctggtttctgcttaggggacggtgggacaatatgcatatggatgtctatgtgggatttgttgcaagagcacaacacaccccttgacctatgcaagtgccagagtgtctgagcccagcttctactcctgttaatgatcacaggagcctcatacacaaccattgtgcatggcggctggagtatggagtagtaaatggtatccagaaaggcaggtctacggtggcatatgggatttcctggtacttcttctttaatagaaactatcttcacagatcatgacatcaggtcagctgcagttctcactgggaccaataaacaatagaagcaacaaccataaagacttaagaggacaaaggaaaccaaacctcactgtgtgtcttcaagatctgttcacatagttgcaggaagttgctgtagacaaagtacattactaaagaatgaagcccacccaggacatcacagcaacgaaagaactatttctggtaactgtggaccaggtgagagccacactgtagaacagcagtgctgccctctcttctttggcgaatgttatgaagacattctgatgcacttaggatcatgattcatgttaaatgtaaattaattgtaaaaataatacatcttgctccaaaatgtggtgacaatttagaagctgtccacatagccagaccactctgtaaatcacagaacctagaaagtaaaaatgtgccataattaggacagcagaaagtaacagtaaaataaagttttaaaaaaaaaaacagaaaataaggatttatctatttgtatttgcttaagaagaggttacctataggatgcagggggaatgggattgatgggcatggggtatactgtgaaaggaaaataaaatcttgggaccaaattcactaagcgaaaaggaaaagttaagcttggnaattgagtcatggaatatgcaaaaaacttccttttgttcctaaacagataagntacaagacanaaggccacanatctcnccaggtggtntccctcacctgacaatataaattaacagcttatcttcataggtaagggacaaagacaacaccagaaaccatccctcaccagccgagacaaaacatagatgtactgagctgaangcanaactgttcctctgcctgctgctttcactgtaacatatagatttggtgagcagtaaatgtagatttactgagctgaatgc

SEQ ID NO: 286663 - DNA, 631 bp, Homo sapiens
tttaaagagacaggctttcattctgttacccaggctggagtacaatggcgagatcatggctcacctgcagccttgaccttctgggctcaagcaattctcctatctcagcctcctgagtagctgggactacaagtgtatgccactatgcctggctaatttttatttttttgtagagacagggtcttgctgtgttgctgagctggtcttgaactcctggcctcccgcctcagtctcccaaagtgctgggattacaggtatgagccactgcaccttctctcctattttctactttgttgatttttaactctcctttctgggaaatttcctcatgttgatttttgaaacctccagctgggtttaaatttttgctactatatttttaatttccaagagttcctttttgttttctgaaaattccttctttaaaaaattgtatcctatacttgtttcatggtggaaataaggttttttgttgttgttgtttttgtttttttgagacagagtttcactcttgttgcccaggctggagtgcaatggtgcaatctcggctcacagcaacctccacctcctgggttcaagcgattctcctgtctcagcctcccgagtatctgggattacaggtacatgccac

SEQ ID NO: 286664 - DNA, 752 bp, Homo sapiens
ggagccctgccagctgggccacccgaggggcgttgcggggctccgggcggggtcgacccggggggctccgtcgggccccaccagccttgcgcctttttcgctcggtctccttggcctcccgctcctgcgacgccgctttccttttctcttgctcccgagctcggacctcggccaggggccccgcccgccagttggtcgcctcctgcagcaccctggaggcccagggccggcggggcggcggctgtggggatcccgggcgcggcccacacctgggacaatgagcaggaacccagagacagggtcttgctgtgttgctgagctggtcttgaactcctggcctcccgcctcagtctcccaaagtgctgggattacagggaatgtgacttcactggacgcagtataaagatcttcagatgtcctcctgccggggattgcagggatcacagaaagaccatcgaggtccaggagctacctgcaagcggagatccctctggacgccccgtgcctcacccagcaaagccggctcacaaccctgcgctctcaaacctctaaaagggcttgaggtgccaataggaaaggaggcccgagattgccacggcatacgtgggccccaaggagggagccaggagtcactgcctgcttgggctaagggtaccgcgtacggaaaggcggcggggacgcggcccagttccaggagatgcgcccaacgaagaagcggaggaacagggtcacgggatagggcagacacccgg

SEQ ID NO: 286665 - DNA, 734 bp, Homo sapiens
actacagtagcagatgataaaaaccaagatggaaagagttactctgcctgaaagaagacacatggttaaaaactgtggagagggaagtgtatgggaggggttacagagcgctagaaaaagactcctgagagtgagggtgggtgcaaacatgtagcaggcaacccgcagcatctgtgggagggtgacagggccctgccacaattggtcaatgcctgctcgccaagaatgagctatgccaaaacccctgcttagagtcgcagagcgggccatgacctaaaattgtccagggacacatcggcctctaacactgcaagatttcctctttcaagcaaacctcaattctcggtcttattaagggaatgtgacttcactggacgcagtataaagatcttcagatgtcctcctgccggggattgcagggatcacagaaagaccatcgaggtccaggagctacctgcaagcggagatccctctggacgccccgtgcctcacccagcaaagccggctcacaaccctgcgctctcaaacctctaaaagggcttgaggtgccaataggaaaggaggcccgagattgccacggcatacgtgggccccaaggagggagccaggagtcactgcctgcttgggctaagggtaccgcgtacggaaaggcggcggggacgcggcccagttccaggagatgcgcccaacgaagaagcggaggaacagggtcacgggatagggcagacacccgg

SEQ ID NO: 286666 - DNA, 387 bp, Homo sapiens
caggtggttgtggcctagcattgtgttaggtggggtttagaaagcatggcatagtggaggagaacggggcacagcttggggtggtaaaggctaggagtagggcgagccctggggctggaattagagcaccctctggaggtgggtgtagacatgtggtggtggcctagcattgtgttaggtggggtttagaaagcatggcatagtggggacattgggagtgggacttgcaaccaagcgtacaggtctatagtgttggggctggacaaagtacagggcacaatggaggatggggcctggaggacaggaggagtcctggtggggtaggactgtggcccagctgtccatccatccctctgtccagtcccacagcattcacccaccgatgtg

SEQ ID NO: 286667 - DNA, 377 bp, Homo sapiens
gcactgttctaaatgctttacatttatttattctcacaatttagcattcccagtttacagctgaggaaattaagcttcaagttgcccaagtttatagaatgagtcaatggcagaggttgaactcagatgacaaaattggggtctggacgtgtgcaaggacttttccaaagtcagctggaaagtctcaaactcctggcttcaaacaatcctcccacctcagtctcctgagttggggttacatgtgtgagccactgcactcatctgcactcagctattcaatttatttttctaatagcctttactaaaaaaaagaaatgtttgtaacagagatttctggggtaaactaaaatggaaaccttccagctacaagcataaaa

SEQ ID NO: 286668 - DNA, 1912 bp, Homo sapiens
gctgccggtaaatctcgcgagaattgatgaagtctcgcggtggctcccggagcctgctgggagagacgtaaggtcggcggagaatgcgcgggtcgagtgctgtagttcgatttttgcgtgtgtgcgttgcttgcggcctttgtgcctttttattctttgcttacctttatgatataaagaccttatttcttacaaggaggaaaagaccgctgacttcagaaacagcgggaaccccagctcgtccccggtaattcaagaggaaacgcttgagcaattactgatgttgtaaactgggatcagaagacatacatggtatcgtatcccaggcaaggcacagtggctcacacctgtaatcccagcactttgggaggctgaagaaggcagatcacttgaggtcaggagttcgagaccagcctggcttacatggtgaaacccatctctactgaacatacaaaaattagctggacatggtggttagctgcacctctactccacgtgttcctcccttcaggtcccaggctgatggagtagcctctgtgtgtttgggatgttgtcagtcataatggtggacacaaaagagattatgacaaaccgtgtattgtctcctacaatttctgctcacagaagtggacaacatcacttctttccacatttcattgaccagagcaagtcatgtgaccaagcctgattcaaaataggctggagcaaggaggagcagcaaacataacattcccagtttacagctgaggaaattaagcttcaagttgcccaagtttatagaatgagtcaatggcagaggttgaactcagatgacaaaattggggtctggacgtgtgcaaggacttttccaaagtcagctggaaaggagctgcttagctgagaggttctggctccaaagtctcctgtgaagttgcagtcaagatgtctgctgggaccccagtcatttgaagccctgtctggggcaggagaatctaggtccaaaatggccgttgcaggagtccttatccacaccatgtgggacctcttcatagatgttcgagtgtcctcatggcatggccactggctttccccaaagtaagcagtccaaaagagggtaagacagagcccacactgtcttttatgaattagccttagaagtctaacacggttacttccaccacattcattagtcgttaggtacagctcacattcatggggaggaaaatcagggcctgtctttagataggagatgtatcaaagaatttgtggacatattttaaaatcacagcactactcttgatgtactaagtcagtgactcccccaggagtctcacagagaattgactccttgcccacctatactacctttgtgggtagagactccagtagtgtgctggttaatgttcaaccagtggctttctagaaaacaaaatgtatggatacatatatatgttctaagttttactgatatgaagaatgtgtagcacagaatttataaataataaaatatacagtattatttattgtaaattccataaaacctgttgtttttcacaaaaggttttagtttatttttcccaaatgcttgtattggtaacattttctgtattacctttttatgtccagacaatcaacaaaactgaaaaagcccagccttgtagcatttgccagttattgtgtaaatgtccccactatggtggatttcaggttaccactatgatatcacagaatgcagaattggaaggagattcacagcagcaccccattatactatattttcaccatacagatgcagtcgatgtaaattacctgaggagcataaataataataaaatgaagttaaataattcggaaatgattttgaaaattgtgttggtttttaatgtaagtttatatgtcagctttaataaaatctgtctttaacaactagctt

SEQ ID NO: 286669 - DNA, 1432 bp, Homo sapiens
gctgccggtaaatctcgcgagaattgatgaagtctcgcggtggctcccggagcctgctgggagagacgtaaggtcggcggagaatgcgcgggtcgagtgctgtagttcgatttttgcgtgtgtgcgttgcttgcggcctttgtgcctttttattctttgcttacctttatgatataaagaccttatttcttacaaggaggaaaagaccgctgacttcagaaacagcgggaaccccagctcgtccccgcattcccagtttacagctgaggaaattaagcttcaagttgcccaagtttatagaatgagtcaatggcagaggttgaactcagatgacaaaattggggtctggacgtgtgcaaggacttttccaaagtcagctggaaaggagctgcttagctgagaggttctggctccaaagtctcctgtgaagttgcagtcaagatgtctgctgggaccccagtcatttgaagccctgtctggggcaggagaatctaggtccaaaatggccgttgcaggagtccttatccacaccatgtgggacctcttcatagatgttcgagtgtcctcatggcatggccactggctttccccaaagtaagcagtccaaaagagggtaagacagagcccacactgtcttttatgaattagccttagaagtctaacacggttacttccaccacattcattagtcgttaggtacagctcacattcatggggaggaaaatcagggcctgtctttagataggagatgtatcaaagaatttgtggacatattttaaaatcacagcactactcttgatgtactaagtcagtgactcccccaggagtctcacagagaattgactccttgcccacctatactacctttgtgggtagagactccagtagtgtgctggttaatgttcaaccagtggctttctagaaaacaaaatgtatggatacatatatatgttctaagttttactgatatgaagaatgtgtagcacagaatttataaataataaaatatacagtattatttattgtaaattccataaaacctgttgtttttcacaaaaggttttagtttatttttcccaaatgcttgtattggtaacattttctgtattacctttttatgtccagacaatcaacaaaactgaaaaagcccagccttgtagcatttgccagttattgtgtaaatgtccccactatggtggatttcaggttaccactatgatatcacagaatgcagaattggaaggagattcacagcagcaccccattatactatattttcaccatacagatgcagtcgatgtaaattacctgaggagcataaataataataaaatgaagttaaataattcggaaatgattttgaaaattgtgttggtttttaatgtaagtttatatgtcagctttaataaaatctgtctttaacaactagctt

SEQ ID NO: 286670 - DNA, 1761 bp, Homo sapiens
gctgccggtaaatctcgcgagaattgatgaagtctcgcggtggctcccggagcctgctgggagagacgtaaggtcggcggagaatgcgcgggtcgagtgctgtagttcgatttttgcgtgtgtgcgttgcttgcggcctttgtgcctttttattctttgcttacctttatgatataaagaccttatttcttacaaggaggaaaagaccgctgacttcagaaacagcgggaaccccagctcgtccccggtaattcaagaggaaacgcttgagcaattactgatgttgtaaactgggatcagaagacatacatggtatcgtatcccaggcaaggcacagtggctcacacctgtaatcccagcactttgggaggctgaagaaggcagatcacttgaggtcaggagttcgagaccagcctggcttacatggtgaaacccatctctactgaacatacaaaaattagctggacatggtgaagtggacaacatcacttctttccacatttcattgaccagagcaagtcatgtgaccaagcctgattcaaaataggctggagcaaggaggagcagcaaacataacattcccagtttacagctgaggaaattaagcttcaagttgcccaagtttatagaatgagtcaatggcagaggttgaactcagatgacaaaattggggtctggacgtgtgcaaggacttttccaaagtcagctggaaaggagctgcttagctgagaggttctggctccaaagtctcctgtgaagttgcagtcaagatgtctgctgggaccccagtcatttgaagccctgtctggggcaggagaatctaggtccaaaatggccgttgcaggagtccttatccacaccatgtgggacctcttcatagatgttcgagtgtcctcatggcatggccactggctttccccaaagtaagcagtccaaaagagggtaagacagagcccacactgtcttttatgaattagccttagaagtctaacacggttacttccaccacattcattagtcgttaggtacagctcacattcatggggaggaaaatcagggcctgtctttagataggagatgtatcaaagaatttgtggacatattttaaaatcacagcactactcttgatgtactaagtcagtgactcccccaggagtctcacagagaattgactccttgcccacctatactacctttgtgggtagagactccagtagtgtgctggttaatgttcaaccagtggctttctagaaaacaaaatgtatggatacatatatatgttctaagttttactgatatgaagaatgtgtagcacagaatttataaataataaaatatacagtattatttattgtaaattccataaaacctgttgtttttcacaaaaggttttagtttatttttcccaaatgcttgtattggtaacattttctgtattacctttttatgtccagacaatcaacaaaactgaaaaagcccagccttgtagcatttgccagttattgtgtaaatgtccccactatggtggatttcaggttaccactatgatatcacagaatgcagaattggaaggagattcacagcagcaccccattatactatattttcaccatacagatgcagtcgatgtaaattacctgaggagcataaataataataaaatgaagttaaataattcggaaatgattttgaaaattgtgttggtttttaatgtaagtttatatgtcagctttaataaaatctgtctttaacaactagctt

SEQ ID NO: 286671 - DNA, 1586 bp, Homo sapiens
gctgccggtaaatctcgcgagaattgatgaagtctcgcggtggctcccggagcctgctgggagagacgtaaggtaattcaagaggaaacgcttgagcaattactgatgttgtaaactgggatcagaagacatacatggtatcgtatcccaggcaaggcacagtggctcacacctgtaatcccagcactttgggaggctgaagaaggcagatcacttgaggtcaggagttcgagaccagcctggcttacatggtgaaacccatctctactgaacatacaaaaattagctggacatggtgaagtggacaacatcacttctttccacatttcattgaccagagcaagtcatgtgaccaagcctgattcaaaataggctggagcaaggaggagcagcaaacataacattcccagtttacagctgaggaaattaagcttcaagttgcccaagtttatagaatgagtcaatggcagaggttgaactcagatgacaaaattggggtctggacgtgtgcaaggacttttccaaagtcagctggaaaggagctgcttagctgagaggttctggctccaaagtctcctgtgaagttgcagtcaagatgtctgctgggaccccagtcatttgaagccctgtctggggcaggagaatctaggtccaaaatggccgttgcaggagtccttatccacaccatgtgggacctcttcatagatgttcgagtgtcctcatggcatggccactggctttccccaaagtaagcagtccaaaagagggtaagacagagcccacactgtcttttatgaattagccttagaagtctaacacggttacttccaccacattcattagtcgttaggtacagctcacattcatggggaggaaaatcagggcctgtctttagataggagatgtatcaaagaatttgtggacatattttaaaatcacagcactactcttgatgtactaagtcagtgactcccccaggagtctcacagagaattgactccttgcccacctatactacctttgtgggtagagactccagtagtgtgctggttaatgttcaaccagtggctttctagaaaacaaaatgtatggatacatatatatgttctaagttttactgatatgaagaatgtgtagcacagaatttataaataataaaatatacagtattatttattgtaaattccataaaacctgttgtttttcacaaaaggttttagtttatttttcccaaatgcttgtattggtaacattttctgtattacctttttatgtccagacaatcaacaaaactgaaaaagcccagccttgtagcatttgccagttattgtgtaaatgtccccactatggtggatttcaggttaccactatgatatcacagaatgcagaattggaaggagattcacagcagcaccccattatactatattttcaccatacagatgcagtcgatgtaaattacctgaggagcataaataataataaaatgaagttaaataattcggaaatgattttgaaaattgtgttggtttttaatgtaagtttatatgtcagctttaataaaatctgtctttaacaactagctt

SEQ ID NO: 286672 - DNA, 714 bp, Homo sapiens
gctgccggtaaatctcgcgagaattgatgaagtctcgcggtggctcccggagcctgctgggagagacgtaaggtcggcggagaatgcgcgggtcgagtgctgtagttcgatttttgcgtgtgtgcgttgcttgcggcctttgtgcctttttattctttgcttacctttatgatataaagaccttatttcttacaaggaggaaaagaccgctgacttcagaaacagcgggaaccccagctcgtccccgcattcccagtttacagctgaggaaattaagcttcaagttgcccaagtttatagaatgagtcaatggcagaggttgaactcagatgacaaaattggggtctggacgtgtgcaaggacttttccaaagtcagctggaaaggagctgcttagctgagaggttctggctccaaagtctcctgtgaagttgcagtcaagatgtctgctgggaccccagtcatttgaagccctgtctggggcaggagaatctaggtccaaaatggccgttgcaggagtccttatccacaccatgtgggacctcttcatagatgttcgagtgtcctcatggcatggccactggctttccccaaacttcaaactatgcatatgggccaggcgcggtagctcatgcctgtaatcccaacactttggaaggtcaaggtgggcagatcatttgaggccaggagtttgagaccagcctggccaacatgg

SEQ ID NO: 286673 - DNA, 1530 bp, Homo sapiens
gggcggggcacttacctctcactgctgctgccgccgcggctgtgcaggcttaggagcggcatggtgcggctggcgtggatggtggcgctgggtttatccccttccttctctctggcgaagcagtggctattgaggatccgctgcagggaggatttcaccatccggccgctggggtccgaaaccaggaaaacctccgctgcgtctctccgcgccgccgccgctgctcgccgttcgcaaaatggcgcctctgccgccgcccgcctttatagatgctgcgcccaggccacgccccccgcgccgccgggaacgcgaccgcacgaggggcagagccgcggggccgccgggaaaaaaagtcgcgcccgcccctcccagcgcctgattggtgaaagggaaagggaaaggaagaggctctctggagattggttgcctggcccgggacctgctgctgctccagccatgtccatgacaaccagagcctgggaggagctggatggcggcctgggcagctgccaggccctggaggaccactctgcgctggccgagacccaggaggacagggcttcagcgacacccaggctggccgactccggcagcgtgccccacgactctcaggtggctgaaggccccagtgtggacaccaggcccaagaagatggaaaaagagcctgccgccagggggaccccaggaacggggaaggagaggctgaaagccggagcgagccctcggagcgtccccgcgcgcaagaaggcgcagaccgcgccgcccctgcagccgccgccgccgcccccggccctgagcgaggagctgccctggggagacctgtcgctcaacaagtgcctggtgctcgcctcgctggtggcgctgctgggctcggctttccagctgtgccgcgacgccgtccctggggaggcagcactccaagcacgtgtgcccgagccctgggtcccgccaagctcagccccgagggagccatcgtcgcccctgcctaagttcgaggccaggcgcctccatcagcgccgcctgcgccccgggcgaggcagaggtcagacccaagattcccgggagtcgggaggctgcagagaacgacgaagaggagcccggcgaggccaccggagaggccgtccgggaggaccgtgtgaccctcgcagaccggggacccaaggagaggcctcggagagaggggaagccgcggaaggagaagccgcggaaggaggagagacctaagaaagagaggccgcggaaagaggagaggccacgggccgccagggagccccgggaagccctaccccagcgctgggagtcacgcgaagggggccaccggccgtgggcacgggactccagggacgccgagcccaggaagaagcaggcctgggtgtccccgaggcgtcccgacgaggagcagcggcctgggagtcgccagaagctccgcgcaggcaaggggcgggactgagccggccccgcgccggagtccaggggccccttctggacgccccgcgactctggcgaaataaagcgagtgctgcggccaaa

SEQ ID NO: 286674 - DNA, 1130 bp, Homo sapiens
acaaggctcagcaaagcggctggcggcctggcccgggacctgctgctgctccagccatgtccatgacaaccagagcctgggaggagctggatggcggcctgggcagctgccaggccctggaggaccactctgcgctggccgagacccaggaggacagggcttcagcgacacccaggctggccgactccggcagcgtgccccacgactctcaggtggctgaaggccccagtgtggacaccaggcccaagaagatggaaaaagagcctgccgccagggggaccccaggaacggggaaggagaggctgaaagccggagcgagccctcggagcgtccccgcgcgcaagaaggcgcagaccgcgccgcccctgcagccgccgccgccgcccccggccctgagcgaggagctgccctggggagacctgtcgctcaacaagtgcctggtgctcgcctcgctggtggcgctgctgggctcggctttccagctgtgccgcgacgccgtccctggggaggcagcactccaagcacgtgtgcccgagccctgggtcccgccaagctcagccccgagggagccatcgtcgcccctgcctaagttcgaggccaggcgcctccatcagcgccgcctgcgccccgggcgaggcagaggtcagacccaagattcccgggagtcgggaggctgcagagaacgacgaagaggagcccggcgaggccaccggagaggccgtccgggaggaccgtgtgaccctcgcagaccggggacccaaggagaggcctcggagagaggggaagccgcggaaggagaagccgcggaaggaggagagacctaagaaagagaggccgcggaaagaggagaggccacgggccgccagggagccccgggaagccctaccccagcgctgggagtcacgcgaagggggccaccggccgtgggcacgggactccagggacgccgagcccaggaagaagcaggcctgggtgtccccgaggcgtcccgacgaggagcagcggcctgggagtcgccagaagctccgcgcaggcaaggggcgggactgagccggccccgcgccggagtccaggggccccttctggacgccccgcgactctggcgaaataaagcgagtgctgcggccaaa

SEQ ID NO: 286675 - DNA, 812 bp, Homo sapiens
gggcggggcacttacctctcactgctgctgccgccgcggctgtgcaggcttaggagcggcatggtgcggctggcgtggatggtggcgctgggtttatccccttccttctctctggcgaagcagtggctattgaggatccgctgcagggaggatttcaccatccggccgctggggtccgaaaccaggaaaacctccgctgcgtctctccgcgccgccgccgctgctcgccgttcgcaaaatggcgcctctgccgccgcccgcctttatagatgctgcgcccaggccacgccccccgcgccgccgggaacgcgaccgcacgaggggcagagccgcggggccgccgggaaaaaaagtcgcgcccgcccctcccagcgcctgattggtgaaagggaaagggaaaggaagaggctctctggagattggttgataaattcagatttttcctgtggaaactgaaacttaccctaaggaaaaacactactcctggcagttaaaattcagaaacacatctcatgtatgaactaaaatgtggatctcccaaggaaaaaacgatttctttggtggtcaagttcggtaaactgtttcgcctgtgaggtaaaatgtggacttacctagcaaaaatatttcccctcctggttaaatccagaaaaaaaatctcaggtatgaactgcactttgcttttaataagcaaagatataactcttggcagtcacatacgggtacatagcttgtgtgtagactaaattatgaatttagcaaaaagttgccactttgcagtgaggtttaataaaatattttttatttcatgtata

SEQ ID NO: 286676 - DNA, 864 bp, Homo sapiens
  misc_feature (8)..(8): n is a, c, g, or t
  misc_feature (31)..(31): n is a, c, g, or t
catcgacnccaatcgtggagagcgctccaangtgacggtacccgttcattcggccattatggccgggtggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacattttttttaacttgatttaataaaaatgttaattttggaagtgc

SEQ ID NO: 286677 - DNA, 3564 bp, Homo sapiens
cgcggaaggcgccgtgcgccggttgctatacaggccgcacttcacaccccgtgcctccccgcctctcctggctcctccgcccagatccccggcgctcccgcgttcggtgacggccgggtaggctgtaggcagcgcaatgccaagacagagctgctggcggcggcgggcgaatctccctgcaccatgagcctcggctccggccccgttaggggccgataagcacagcgcacgccgccctccatttgccccggggcctcggctgcgaagatagcggcggccggacaggaagctcgaggaaagcgctgggccgggtctctacgaacacgtgaaggaaaagcagctccgtccacaacgccgcttcggggctcctagggagtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgttttctgtagaaaatgtttcctgactgcaatgagggaaagcggagcacattgtcccctatgtcgtggaaatgtgactagaagagagagagcatgtcctgaacgggccttagaccttgaaaatataatgaggaagttttctggtagctgcagatgctgtgcaaaacagattaaattctatcgcatgagacatcattacaaatcttgtaagaagtatcaggatgaatatggtgtttcttctatcattccaaactttcagatctctcaagattcagtagggaacagcaataggagtgaaacatccacatctgataacacagaaacttaccaagagaatacaagttcttctggtcatcctacttttaagtgtcccctgtgtcaagaatcaaattttaccagacagcgtttactggatcactgtaacagtaatcacctatttcagatagttcctgtgacatgtcctatttgtgtgtctcttccttggggagatcctagccagattaccagaaatttcgttagtcatctaaatcagagacatcaatttgattatggagaatttgtgaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaaaaaagatgtttcactaatgtaacggtgaaagagaatccctgttgtactttatctttttgtaatattatttttgaatttttcattattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataagaaaattgtatttatataacatttactatttttgaagactagtgagatttctgtaataattttaattctttaaaaagtgaaagcttgttgtaaagatattttctttttgttattagaaggaaatacaaagagaaaaatttctttctttcatgggcatttgataatttcagtctttgactgatttgtaagcctagaatatactaagctgaataacagctctttggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacattttttttaacttgatttaataaaaatgttaattttggaagtgcagttttgtaaaaacctttttcagtcaaacagtaaagactttatttatggattgtaataacaaccacaagaaaagccatacatcttaatgaacatacgcctttgttctgtcattttaaagagtggtgtttactatgtgtgtgcttgagcattttctttcagttacatgggtgtaatttaaaaacagctcctttttaagagacttttgaccatagtgttttccagtttaaagcaataactttcatagtttctttcaaagtttaatacatccaatatgtcaagttaaaccattctgggatttgcaaagtttaatacatccaatatgtcaagttaaaccattctgggatttgcaaagtttaatacatccaatatgtcaagttaaaccattctgggatttgggaacttctttaaaggaaaattgtagtagaggtcatcttgatggaattgtgttttaaagttttgtgaatgagttaaatatcattgatagtcttgtgtgtctcacatatcagctttttcataaggaaaatactttatttgcttttatctgagaatttctcagtatgaaaatgattgtttaaaatttcccctctttttgtcagtgcattgggaatagggatagactttacagatttatggaaattaaatttatggggaaaagtttttatttttaatattacttatagctgagtcagaattaaaggagggaattgtattgatactccaatacctaaatttcacaataccacttaggaaagctatttcaacaaattacagttttattgttaaaacagagtcttatttgagatgtattgctttatttttcaattaaaagtggttttctccta

SEQ ID NO: 286678 - DNA, 3136 bp, Homo sapiens
  misc_feature (2973)..(2973): n is a, c, g, or t
  misc_feature (2981)..(2981): n is a, c, g, or t
cgcggaaggcgccgtgcgccggttgctatacaggccgcacttcacaccccgtgcctccccgcctctcctggctcctccgcccagatccccggcgctcccgcgttcggtgacggccgggtaggctgtaggcagcgcaatgccaagacagagctgctggcggcggcgggcgaatctccctgcaccatgagcctcggctccggccccgttaggggccgataagcacagcgcacgccgccctccatttgccccggggcctcggctgcgaagatagcggcggccggacaggaagctcgaggaaagcgctgggccgggtctctacgaacacgtgaaggaaaagcagctccgtccacaacgccgcttcggggctcctagggagtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgttttctgtagaaaatgtttcctgactgcaatgagggaaagcggagcacattgtcccctatgtcgtggaaatgtgactagaagagagagagcatgtcctgaacgggccttagaccttgaaaatataatgaggaagttttctggtagctgcagatgctgtgcaaaacagattaaattctatcgcatgagacatcattacaaatcttgtaagaagtatcaggatgaatatggtgtttcttctatcattccaaactttcagatctctcaagattcagtagggaacagcaataggagtgaaacatccacatctgataacacagaaacttaccaagagaatacaagttcttctggtcatcctacttttaagtgtcccctgtgtcaagaatcaaattttaccagacagcgtttactggatcactgtaacagtaatcacctatttcagatagttcctgtgacatgtcctatttgtgtgtctcttccttggggagatcctagccagattaccagaaatttcgttagtcatctaaatcagagacatcaatttgattatggagaatttgtgaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaaaaaagatgtttcactaatgtaacggtgaaagagaatccctgttgtactttatctttttgtaatattatttttgaatttttcattattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataagaaaattgtatttatataacatttactatttttgaagactagtgagatttctgtaataattttaattctttaaaaagtgaaagcttgttgtaaagatattttctttttgttattagaaggaaatacaaagagaaaaatttctttctttcatgggcatttgataatttcagtctttgactgatttgtaagcctagaatatactaagctgaataacagctctttggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacattttttttaacttgatttaataaaaatgttaattttggaagtgcagttttgtaaaaacctttttcagtcaaacagtaaagactttatttatggattgtaataacaaccacaagaaaagccatacatcttaatgaacatacgcctttgttctgtcattttaaagagtggtgtttactatgtgtgtgcttgagcattttctttcagttacatgggtgtaatttaaaaacagctcctttttaagagacttttgaccatagtgttttccagtttaaagcaataactttcatagttttcanaggtatantcccatgttagtaacctcggtgcaagtattcctccaccgtgtcggttacctgggtgggcccttaggaagagaagccactgacggtgagggggcacaccaggtgtccacactacgaaacagttgagacaaaaaccctcgggaaaaaaaaatacacc

SEQ ID NO: 286679 - DNA, 2721 bp, Homo sapiens
cgcggaaggcgccgtgcgccggttgctatacaggccgcacttcacaccccgtgcctccccgcctctcctggctcctccgcccagatccccggcgctcccgcgttcggtgacggccgggtaggctgtaggcagcgcaatgccaagacagagctgctggcggcggcgggcgaatctccctgcaccatgagcctcggctccggccccgttaggggccgataagcacagcgcacgccgccctccatttgccccggggcctcggctgcgaagatagcggcggccggacaggaagctcgaggaaagcgctgggccgggtctctacgaacacgtgaaggaaaagcagctccgtccacaacgccgcttcggggctcctagggagtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgttttctgtagaaaatgtttcctgactgcaatgagggaaagcggagcacattgtcccctatgtcgtggaaatgtgactagaagagagagagcatgtcctgaacgggccttagaccttgaaaatataatgaggaagttttctggtagctgcagatgctgtgcaaaacagattaaattctatcgcatgagacatcattacaaatcttgtaagaagtatcaggatgaatatggtgtttcttctatcattccaaactttcagatctctcaagattcagtagggaacagcaataggagtgaaacatccacatctgataacacagaaacttaccaagagaatacaagttcttctggtcatcctacttttaagtgtcccctgtgtcaagaatcaaattttaccagacagcgtttactggatcactgtaacagtaatcacctatttcagatagttcctgtgacatgtcctatttgtgtgtctcttccttggggagatcctagccagattaccagaaatttcgttagtcatctaaatcagagacatcaatttgattatggagaatttgtgaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaaaaaagatgtttcactaatgtaacggtgaaagagaatccctgttgtactttatctttttgtaatattatttttgaatttttcattattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataagaaaattgtatttatataacatttactatttttgaagactagtgagatttctgtaataattttaattctttaaaaagtgaaagcttgttgtaaagatattttctttttgttattagaaggaaatacaaagagaaaaatttctttctttcatgggcatttgataatttcagtctttgactgatttgtaagcctagaatatactaagctgaataacagctctttggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacattttttttaacttgatttaataaaaatgttaattttggaagtgc

SEQ ID NO: 286680 - DNA, 2510 bp, Homo sapiens
  misc_feature (5)..(6): n is a, c, g, or t
  misc_feature (25)..(25): n is a, c, g, or t
  misc_feature (27)..(27): n is a, c, g, or t
  misc_feature (36)..(36): n is a, c, g, or t
  misc_feature (50)..(50): n is a, c, g, or t
  misc_feature (54)..(54): n is a, c, g, or t
tctcnnctcatagggcacaagcggngntccacctgntgaggccgctctanactntgaccccggcggccggacaggaagctcgaggaaagcgctgggccgggtctctacgaacacgtgaaggaaaagcagctccgtccacaacgccgcttcggggctcctagggagtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgttttctgtagaaaatgtttcctgactgcaatgagggaaagcggagcacattgtcccctatgtcgtggaaatgtgactagaagagagagagcatgtcctgaacgggccttagaccttgaaaatataatgaggaagttttctggtagctgcagatgctgtgcaaaacagattaaattctatcgcatgagacatcattacaaatcttgtaagaagtatcaggatgaatatggtgtttcttctatcattccaaactttcagatctctcaagattcagtagggaacagcaataggagtgaaacatccacatctgataacacagaaacttaccaagagaatacaagttcttctggtcatcctacttttaagtgtcccctgtgtcaagaatcaaattttaccagacagcgtttactggatcactgtaacagtaatcacctatttcagatagttcctgtgacatgtcctatttgtgtgtctcttccttggggagatcctagccagattaccagaaatttcgttagtcatctaaatcagagacatcaatttgattatggagaatttgtgaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaaaaaagatgtttcactaatgtaacggtgaaagagaatccctgttgtactttatctttttgtaatattatttttgaatttttcattattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataagaaaattgtatttatataacatttactatttttgaagactagtgagatttctgtaataattttaattctttaaaaagtgaaagcttgttgtaaagatattttctttttgttattagaaggaaatacaaagagaaaaatttctttctttcatgggcatttgataatttcagtctttgactgatttgtaagcctagaatatactaagctgaataacagctctttggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacattttttttaacttgatttaataaaaatgttaattttggaagtgc

SEQ ID NO: 286681 - DNA, 2170 bp, Homo sapiens
  misc_feature (13)..(13): n is a, c, g, or t
cgacccacgcgtncgtcgacccacgcgtcgcggacgcgtgggtcgagcggagcacattgtcccctatgtcgtggaaatgtgactagaagagagagagcatgtcctgaacgggccttagaccttgaaaatataatgaggaagttttctggtagctgcagatgctgtgcaaaacagattaaattctatcgcatgagacatcattacaaatcttgtaagaagtatcaggatgaatatggtgtttcttctatcattccaaactttcagatctctcaagattcagtagggaacagcaataggagtgaaacatccacatctgataacacagaaacttaccaagagaatacaagttcttctggtcatcctacttttaagtgtcccctgtgtcaagaatcaaattttaccagacagcgtttactggatcactgtaacagtaatcacctatttcagatagttcctgtgacatgtcctatttgtgtgtctcttccttggggagatcctagccagattaccagaaatttcgttagtcatctaaatcagagacatcaatttgattatggagaatttgtgaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaaaaaagatgtttcactaatgtaacggtgaaagagaatccctgttgtactttatctttttgtaatattatttttgaatttttcattattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataagaaaattgtatttatataacatttactatttttgaagactagtgagatttctgtaataattttaattctttaaaaagtgaaagcttgttgtaaagatattttctttttgttattagaaggaaatacaaagagaaaaatttctttctttcatgggcatttgataatttcagtctttgactgatttgtaagcctagaatatactaagctgaataacagctctttggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacattttttttaacttgatttaataaaaatgttaattttggaagtgc

SEQ ID NO: 286682 - DNA, 2439 bp, Homo sapiens
cgcggaaggcgccgtgcgccggttgctatacaggccgcacttcacaccccgtgcctccccgcctctcctggctcctccgcccagatccccggcgctcccgcgttcggtgacggccgggtaggctgtaggcagcgcaatgccaagacagagctgctggcggcggcgggcgaatctccctgcaccatgagcctcggctccggccccgttaggggccgataagcacagcgcacgccgccctccatttgccccggggcctcggctgcgaagatagcggcggccggacaggaagctcgaggaaagcgctgggccgggtctctacgaacacgtgaaggaaaagcagctccgtccacaacgccgcttcggggctcctagggagtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgtcaataggagtgaaacatccacatctgataacacagaaacttaccaagagaatacaagttcttctggtcatcctacttttaagtgtcccctgtgtcaagaatcaaattttaccagacagcgtttactggatcactgtaacagtaatcacctatttcagatagttcctgtgacatgtcctatttgtgtgtctcttccttggggagatcctagccagattaccagaaatttcgttagtcatctaaatcagagacatcaatttgattatggagaatttgtgaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaaaaaagatgtttcactaatgtaacggtgaaagagaatccctgttgtactttatctttttgtaatattatttttgaatttttcattattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataagaaaattgtatttatataacatttactatttttgaagactagtgagatttctgtaataattttaattctttaaaaagtgaaagcttgttgtaaagatattttctttttgttattagaaggaaatacaaagagaaaaatttctttctttcatgggcatttgataatttcagtctttgactgatttgtaagcctagaatatactaagctgaataacagctctttggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacattttttttaacttgatttaataaaaatgttaattttggaagtgc

SEQ ID NO: 286683 - DNA, 2664 bp, Homo sapiens
cgcggaaggcgccgtgcgccggttgctatacaggccgcacttcacaccccgtgcctccccgcctctcctggctcctccgcccagatccccggcgctcccgcgttcggtgacggccgggtaggctgtaggcagcgcaatgccaagacagagctgctggcggcggcgggcgaatctccctgcaccatgagcctcggctccggccccgttaggggccgataagcacagcgcacgccgccctccatttgccccggggcctcggctgcgaagatagcggcggccggacaggaagctcgaggaaagcgctgggccgggtctctacgaacacgtgaaggaaaagcagctccgtccacaacgccgcttcggggctcctagggagtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgttttctgtagaaaatgtttcctgactgcaatgagggaaagcggagcacattgtcccctatgtcgtggaaatgtgactagaagagagagagcatgtcctgaacgggccttagaccttgaaaatataatgaggaagttttctggtagctgcagatgctgtgcaaaacagattaaattctatcgcatgagacatcattacaaatcttgtaagaagtatcaggatgaatatggtgtttcttctatcattccaaactttcagatctctcaagattcagtagggaacagttcttctggtcatcctacttttaagtgtcccctgtgtcaagaatcaaattttaccagacagcgtttactggatcactgtaacagtaatcacctatttcagatagttcctgtgacatgtcctatttgtgtgtctcttccttggggagatcctagccagattaccagaaatttcgttagtcatctaaatcagagacatcaatttgattatggagaatttgtgaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaaaaaagatgtttcactaatgtaacggtgaaagagaatccctgttgtactttatctttttgtaatattatttttgaatttttcattattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataagaaaattgtatttatataacatttactatttttgaagactagtgagatttctgtaataattttaattctttaaaaagtgaaagcttgttgtaaagatattttctttttgttattagaaggaaatacaaagagaaaaatttctttctttcatgggcatttgataatttcagtctttgactgatttgtaagcctagaatatactaagctgaataacagctctttggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacattttttttaacttgatttaataaaaatgttaattttggaagtgc

SEQ ID NO: 286684 - DNA, 2687 bp, Homo sapiens
cgcggaaggcgccgtgcgccggttgctatacaggccgcacttcacaccccgtgcctccccgcctctcctggctcctccgcccagatccccggcgctcccgcgttcggtgacggccgggtaggctgtaggcagcgcaatgccaagacagagctgctggcggcggcgggcgaatctccctgcaccatgagcctcggctccggccccgttaggggccgataagcacagcgcacgccgccctccatttgccccggggcctcggctgcgaagatagcggcggccggacaggaagctcgaggaaagcgctgggccgggtctctacgaacacgtgaaggaaaagcagctccgtccacaacgccgcttcggggctcctagggagtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgttttctgtagaaaatgtttcctgactgcaatgagggaaagcggagcacattgtcccctatgtcgtggaaatgtgactagaagagagagagcatgtcctgaacgggccttagaccttgaaaatataatgaggaagttttctggtagctgcagatgctgtgcaaaacagattaaattctatcgcatgagacatcattacaaatcttgtaagaagtatcaggatgaatatggtgtttcttctatcattccaaactttcagatctctcaagattcagtagggaacagcaataggagtgaaacatccacatctgataacacagaaacttaccaagagaatacaagttcttctggtcatcctacttttaagtgtcccctgtgtcaagaatcaaattttaccagacagcgtttactggatcactgtaacagtaatcacctatttcagatagttcctgtgatcctagccagattaccagaaatttcgttagtcatctaaatcagagacatcaatttgattatggagaatttgtgaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaaaaaagatgtttcactaatgtaacggtgaaagagaatccctgttgtactttatctttttgtaatattatttttgaatttttcattattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataagaaaattgtatttatataacatttactatttttgaagactagtgagatttctgtaataattttaattctttaaaaagtgaaagcttgttgtaaagatattttctttttgttattagaaggaaatacaaagagaaaaatttctttctttcatgggcatttgataatttcagtctttgactgatttgtaagcctagaatatactaagctgaataacagctctttggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacattttttttaacttgatttaataaaaatgttaattttggaagtgc

SEQ ID NO: 286685 - DNA, 1186 bp, Homo sapiens
cgcggaaggcgccgtgcgccggttgctatacaggccgcacttcacaccccgtgcctccccgcctctcctggctcctccgcccagatccccggcgctcccgcgttcggtgacggccgggtaggctgtaggcagcgcaatgccaagacagagctgctggcggcggcgggcgaatctccctgcaccatgagcctcggctccggccccgttaggggccgataagcacagcgcacgccgccctccatttgccccggggcctcggctgcgaagatagcggcggccggacaggaagctcgaggaaagcgctgggccgggtctctacgaacacgtgaaggaaaagcagctccgtccacaacgccgcttcggggctcctagggagtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgttttctgtagaaaatgtttcctgactgcaatgagggaaagcggagcacattgtcccctatgtcgtggaaatgtgactagaagagagagagcatgtcctgaacgggccttagaccttgaaaatataatgaggaagttttctggtagctgcagatgctgtgcaaaacagattaaattctatcgcatgagacatcattacaaatcttgtaagaagtatcaggatgaatatggtgtttcttctatcattccaaactttcagatctctcaagattcagtagggaacagcaataggagtgaaacatccacatctgataacacagaaacttaccaagagaatacaagttcttctggtcatcctacttttaagtgtcccctgtgtcaagaatcaaattttaccagacagcgtttactggatcactgtaacagtaatcacctatttcagatagttcctgtgacctgttctatatgggtgtctcttccctggggagatcctagccgatttccggtttcggtggcactctatctcgagactcacttgattcagggaatggtgatctcagctgatgagaacccataccaacgttgtggacaatcttcacgtacttcagcggtccctggctgttctgcgcc

SEQ ID NO: 286686 - DNA, 1584 bp, Homo sapiens
gtttttcctgttgacatgaatgttattgtttttagaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaattttgtaatattatttttgaatttttcattattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataagaaaattgtatttatataacatttactatttttgaagactagtgagatttctgtaataattttaattctttaaaaagtgaaagcttgttgtaaagatattttctttttgttattagaaggaaatacaaagagaaaaatttctttctttcatgggcatttgataatttcagtctttgactgatttgtaagcctagaatatactaagctgaataacagctctttggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacattttttttaacttgatttaataaaaatgttaattttggaagtgc

SEQ ID NO: 286687 - DNA, 1262 bp, Homo sapiens
gtttcactactttttagttaaacagtggttggtagaatctttctcactatatcacggtcacacattatatttgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacattttttttaacttgatttaataaaaatgttaattttggaagtgcagttttgtaaaaacctttttcagtcaaacagtaaagactttatttatggattgtaataacaaccacaagaaaagccatacatcttaatgaacatacgcctttgttctgtcattttaaagagtggtgtttactatgtgtgtgcttgagcattttctttcagttacatgggtgtaatttaaaaacagctcctttttaagagacttttgaccatagtgttttccagtttaaagcaataactttcatagtttctttcaaagtttaatacatccaatatgtcaagttaaaccattctgggatttgcaaagtttaatacatccaatatgtcaagttaaaccattctgggatttgcaaagtttaatacatccaatatgtcaagttaaaccattctgggatttgggaacttctttaaaggaaaattgtagtagaggtcatcttgatggaattgtgttttaaagttttgtgaatgagttaaatatcattgatagtcttgtgtgtctcacatatcagctttttcataaggaaaatactttatttgcttttatctgagaatttctcagtatgaaaatgattgtttaaaatttcccctctttttgtcagtgcattgggaatagggatagactttacagatttatggaaattaaatttatggggaaaagtttttatttttaatattacttatagctgagtcagaattaaaggagggaattgtattgatactccaatacctaaatttcacaataccacttaggaaagctatttcaacaaattacagttttattgttaaaacagagtcttatttgagatgtattgctttatttttcaattaaaagtggttttctccta

SEQ ID NO: 286688 - DNA, 706 bp, Homo sapiens
gacaataaatactctaattttctgtgacatctaaaagttataattctttactcagtagaagacagctatcaggtgctaaaataaaaaaaagatacctaacccaataaaggcaaaatcttagttatattaaccagcaaggtacatattacattattattactagaccatgcctccaagtgtgtcaaattataaaaatgtgttcagcatacataaaatatacattaaagatttctctcatcataggcacaatctaatacaaaaatatatttgacatttataagttagaagatccattgagagcctccaaaataggacaggggaaggaatgagtgatgacaacataaaaaaagaagcacacatagatgcaaatagttccacttatatgattattttcttcatcagcaaagggttaagagcagtttacaccaaaccaagttaccaagcagatcacaatcagttcacaggttggataagtcacggcacgcaggccagaaaatgtacttttttttttttttttttttgtaaaaattattttattatttcctatttttttttcataggatggggtctcactatattgcccagcctagtctttaacttccggctttaagcagtcctcctgcctcagcctctcaaagtattgatattatgggcatgagcccctgcacccagcctgatttttttaatttgtataaatttatggggt

SEQ ID NO: 286689 - DNA, 1487 bp, Homo sapiens
gacaataaatactctaattttctgtgacatctaaaagttataattctttactcagtagaagacagctatcaggtgctaaaataaaaaaaagatacctaacccaataaaggcaaaatcttagttatattaaccagcaaggtacatattacattattattactagaccatgcctccaagtgtgtcaaattataaaaatgtgttcagcatacataaaatatacattaaagatttctctcatcataggcacaatctaatacaaaaatatatttgacatttataagttagaagatccattgagagcctccaaaataggacaggggaaggaatgagtgatgacaacataaaaaaagaagcacacatagatgcaaatagttccacttatatgattattttcttcatcagcaaagggttaagagcagtttacaccaaaccaagttaccaagcagatcacaatcagttcacaggttggataagtcacggcacgcaggccagaaaatgtactcagacttcagtcaacctaatgggacagtgtactcacactgtggttttgttgttttggagtctagaagctccatctacccattctccatggtctaccaccatgttaacacagatttaccacaggcgccatctgtaccaagcctaggatagactctttaaaaaaaaaaagacctggccggtcacagtggttcatgcctgtaagcattttgagaggacaaggtgggtggatcatgaggtcaggagttcaagaccagcctggccaaggtggtggaaccctgcctctactaaaactgcaaaaattagccaggcacggtggcaggaacttgtaatcccagctacttgggaggctcaggcagaagaatcgcttaaacccgggtgacagaggttgcagtgagcacagatcacaccactgcactccagcctgggcaacagagtgagactctgtttcaaaataaaaataaaaataaagattaaaaattttaaaaagacctacactttgactagtaaagaaaacctacaggatggtgttgcaaaacgcaaaattgtctatccagttaagtgagctgaacacaaactaatctgaagtcctgaactctctgtggggaaataaaagtattttttttaagcaggcagaaataaatgttttgaaaaagattcaaaagcacaggaccttatataatctttgaatgtggaataatagttcaaacaatattttgaactgaaaattcaagaatgaactctcaaacaaaaatgtcatgattcagaatgctccatgatgatgacagaaaagcttgtcacctatgctgcatgttaagaagagagaaaaatggcaacagccgtattttaaagattcataatgttcttcccttccatctagttaaaaccagatgtccaggccgggcacggtggctcacaccagtaatcccagctctttgggattacaggtatgagccactgcgcccagccccaatattttttaatataaa

SEQ ID NO: 286690 - DNA, 1433 bp, Homo sapiens
gacaataaatactctaattttctgtgacatctaaaagttataattctttactcagtagaagacagctatcaggtgctaaaataaaaaaaagatacctaacccaataaaggcaaaatcttagttatattaaccagcaaggtacatattacattattattactagaccatgcctccaagtgtgtcaaattataaaaatgtgttcagcatacataaaatatacattaaagatttctctcatcataggcacaatctaatacaaaaatatatttgacatttataagttagaagatccattgagagcctccaaaataggacaggggaaggaatgagtgatgacaacttcatcagcaaagggttaagagcagtttacaccaaaccaagttaccaagcagatcacaatcagttcacaggttggataagtcacggcacgcaggccagaaaatgtactcagacttcagtcaacctaatgggacagtgtactcacactgtggttttgttgttttggagtctagaagctccatctacccattctccatggtctaccaccatgttaacacagatttaccacaggcgccatctgtaccaagcctaggatagactctttaaaaaaaaaaagacctggccggtcacagtggttcatgcctgtaagcattttgagaggacaaggtgggtggatcatgaggtcaggagttcaagaccagcctggccaaggtggtggaaccctgcctctactaaaactgcaaaaattagccaggcacggtggcaggaacttgtaatcccagctacttgggaggctcaggcagaagaatcgcttaaacccgggtgacagaggttgcagtgagcacagatcacaccactgcactccagcctgggcaacagagtgagactctgtttcaaaataaaaataaaaataaagattaaaaattttaaaaagacctacactttgactagtaaagaaaacctacaggatggtgttgcaaaacgcaaaattgtctatccagttaagtgagctgaacacaaactaatctgaagtcctgaactctctgtggggaaataaaagtattttttttaagcaggcagaaataaatgttttgaaaaagattcaaaagcacaggaccttatataatctttgaatgtggaataatagttcaaacaatattttgaactgaaaattcaagaatgaactctcaaacaaaaatgtcatgattcagaatgctccatgatgatgacagaaaagcttgtcacctatgctgcatgttaagaagagagaaaaatggcaacagccgtattttaaagattcataatgttcttcccttccatctagttaaaaccagatgtccaggccgggcacggtggctcacaccagtaatcccagctctttgggattacaggtatgagccactgcgcccagccccaatattttttaatataaa

SEQ ID NO: 286691 - DNA, 770 bp, Homo sapiens
gacaataaatactctaattttctgtgacatctaaaagttataattctttactcagtagaagacagctatcaggtgctaaaataaaaaaaagatacctaacccaataaaggcaaaatcttagttatattaaccagcaaggtacatattacattattattactagaccatgcctccaagtgtgtcaaattataaaaatgtgttcagcatacataaaatatacattaaagatttctctcatcataggcacaatctaatacaaaaatatatttgacatttataagttagaagatccattgagagcctccaaaataggacaggggaaggaatgagtgatgacaacataaaaaaagaagcacacatagatgcaaatagttccacttatatgattattttcttcatcagcaaagggttaagagcagtttacaccaaaccaagttaccaagcagatcacaatcagttcacaggttggataagtcacggcacgcaggccagaaaatgtactcagacttcagtcaacctaatgggacagtgtactcacactgtggttttgttgttttggagtctagaagctccatctacccattctccatggtctaccaccatgttaacaccaaaagagtcacacttttagttgtaaaattatcttctattaatatttgctcttacttggttggctttcaaaggaaaaagagtgtccatcgctttgaaacattctgtagacaatctggagatgactatttctggtgacataacttcagctgaagattttg

SEQ ID NO: 286692 - DNA, 826 bp, Homo sapiens
tgtaatcccagctacttgggaggctcaggcagaagaatcgcttaaacccgggtgacagaggttgcagtgagcacagatcacaccactgcactccagcctgggcaacagagtgagactctgtttcaaaataaaaataaaaataaagattaaaaattttaaaaagacctacactttgactagtaaagaaaacctacaggatggtgttgcaaaacgcaaaattgtctatccagttaagtgagctgaacacaaactaatctgaagtcctgaactctctgtggggaaataaaagtattttttttaagcaggcagaaataaatgttttgaaaaagattcaaaagcacaggaccttatataatctttgaatgtggaataatagttcaaacaatattttgaactgaaaattcaagaatgaactctcaaacaaaaatgtcatgattcagaatgctccatgatgatgacagaaaagcttgtcacctatgctgcatgttaagaagagagaaaaatggcaacagccgtattttaaagattcataatgttcttcccttccatctagttaaaaccagatgtccaggccgggcacggtggctcacaccagtaatcccagctctttgggaggccaaggcgggtggatcacgaggtcaggagatggagacaatcctggctaacatggtgaaaccccatctttactaaaaatacaaaaaaaattagccgggtgtggttgcgggtgcctgtagtcccagctacttgggaggctgaggcaggagaatggtgtgaacccaggaggcagaggttgcagtgagccaagatcacgccactgcactccagc

SEQ ID NO: 286693 - DNA, 784 bp, Homo sapiens
gtttcctcgagcaggtcctctctagccggccgcttatctatggtttctgctatagggcgctctagcctgcgccaaggggtagtgagaccgcgcggcaacagcttgcggctgcggggagctcccgtgggcgctccgctggctgtgcaggcggccatggattccttgcggaaaatgctgatctcagtcgcaatgctgggcgcaggggctggcgtgggctacgcgctcctcgttatcgtgaccccgggagagcggcggaagcaggaaatgctaaaggtagaagcaactggtagtcccgaggaagggtgtggcgggtggagagccccggactggagctcctgcgaactccccttcctgccctcaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgccagcgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtgagctgccgtcgggtgagcacgtttcccccaaaccctggactgactgctttaaggtccgcaaggcgggccagggccgagacgcgagtcggatgtggtgaactgaaagaaccaataaaatcatgttcctccacc

SEQ ID NO: 286694 - DNA, 696 bp, Homo sapiens
gtttcctcgagcaggtcctctctagccggccgcttatctatggtttctgctatagggcgctctagcctgcgccaaggggtagtgagaccgcgcggcaacagcttgcggctgcggggagctcccgtgggcgctccgctggctgtgcaggcggccatggattccttgcggaaaatgctgatctcagtcgcaatgctgggcgcaggggctggcgtgggctacgcgctcctcgttatcgtgaccccgggagagcggcggaagcaggaaatgctaaaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgccagcgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtgagctgccgtcgggtgagcacgtttcccccaaaccctggactgactgctttaaggtccgcaaggcgggccagggccgagacgcgagtcggatgtggtgaactgaaagaaccaataaaatcatgttcctccacc

SEQ ID NO: 286695 - DNA, 907 bp, Homo sapiens
gtttcctcgagcaggtcctctctagccggccgcttatctatggtttctgctatagggcgctctagcctgcgccaaggggtagtgagaccgcgcggcaacagcttgcggctgcggggagctcccgtgggcgctccgctggctgtgcaggcggccatggattccttgcggaaaatgctgatctcagtcgcaatgctgggcgcaggggctggcgtgggctacgcgctcctcgttatcgtgaccccgggagagcggcggaagcaggaaatgctaaaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgccagcgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtgagctgccgtcgggtgagcacgtttcccccaaaccctggactgactgctttaaggtccgcaaggcgggccagggccgagacgcgagtcggatgtggtgaactgaaagaaccaataaaatcatgttcctccacccagaatgagccctgcagtcgacacctaccaatgcttagagacgcgtggtcggtgctgggggcgcggcctggagctgctgcctgtcccaccccaccagaagaggctgatcccgataggtatctgaccacatttttttttttttttttttttgagacggagtcaatgtcacccaggctggagtgcagtggcacgatctcggctcactgcaacc

SEQ ID NO: 286696 - DNA, 869 bp, Homo sapiens
gtttcctcgagcaggtcctctctagccggccgcttatctatggtttctgctatagggcgctctagcctgcgccaaggggtagtgagaccgcgcggcaacagcttgcggctgcggggagctcccgtgggcgctccgctggctgtgcaggcggccatggattccttgcggaaaatgctgatctcagtcgcaatgctgggcgcaggggctggcgtgggctacgcgctcctcgttatcgtgaccccgggagagcggcggaagcaggaaatgctaaaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgccagcgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtgagctgccgtcgggtgagcacgtttcccccaaaccctggactgactgctttaaggtccgcaaggcgggccagggccgagacgcgagtcggatgtggtgaactgaaagaaccaataaaatcatgttcctccaccaaaaaaaaaaaaaaaaaaaaaattggggggcgcccgcccccaaaaaattttacacccttctgggggcgcggccgggagggactgggcacgggcccgggacccgggcgaagggggggtccccaaaaaagcccggcccgcggtggcacaccagggggggcgggtacgggcagcta

SEQ ID NO: 286697 - DNA, 931 bp, Homo sapiens
gtttcctcgagcaggtcctctctagccggccgcttatctatggtttctgctatagggcgctctagcctgcgccaaggggtagtgagaccgcgcggcaacagcttgcggctgcggggagctcccgtgggcgctccgctggctgtgcaggcggccatggattccttgcggaaaatgctgatctcagtcgcaatgctgggcgcaggggctggcgtgggctacgcgctcctcgttatcgtgaccccgggagagcggcggaagcaggaaatgctaaaggaggcagcgaccacgcaggagaacgtggcctggaggaagaactggatggttggcggcgaaggcggcgccagcgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtgagctgccgtcgggtgagcacgtttcccccaaaccctggactgactgctttaaggtccgcaaggcgggccagggccgagacgcgagtcggatgtggtgaactgaaagaaccaataaaatcatgttcctccaccaaaaaaataaaaaaagaacagaaacaaatgttggtgggggtttttcgaaaggggtttctctaaccggttaaaaatgggggatctctagcaaaaaagccggggttcatttgggaggagtacgcccacgcgtgggtgttttcccccctgtgccagacacttatcgtcgacaagtgttcccaaggggacaatcacgcggggctttaaccagggcaatttggagaccgccttatgtaacgcctcttttagacccggagaagcaacgacgatcggctcagcagaccgacagacagacggaccacagcaccacgag

SEQ ID NO: 286698 - DNA, 995 bp, Homo sapiens
gtttcctcgagcaggtcctctctagccggccgcttatctatggtttctgctatagggcgctctagcctgcgccaaggggtagtgagaccgcgcggcaacagcttgcggctgcggggagctcccgtgggcgctccgctggctgtgcaggcggccatggattccttgcggaaaatgctgatctcagtcgcaatgctgggcgcaggggctggcgtgggctacgcgctcctcgttatcgtgaccccgggagagcggcggaagcaggaaatgctaaaggtagaagcaactggtagtcccgaggaagggtgtggcgggtggagagccccggactggagctcctgcgaactccccttcctgccctcaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgccagcgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtgagctgccgtcgggtgagcacgtttcccccaaaccctggactgactgctttaaggtccgcaaggcgggccagggccgagacgcgagtcggatgtggtgaactgaaagaaccaataaaatcatgttcctccacccagaatgagccctgcagtcgacacctaccaatgcttagagacgcgtggtcggtgctgggggcgcggcctggagctgctgcctgtcccaccccaccagaagaggctgatcccgataggtatctgaccacatttttttttttttttttttttgagacggagtcaatgtcacccaggctggagtgcagtggcacgatctcggctcactgcaacc

SEQ ID NO: 286699 - DNA, 523 bp, Homo sapiens
tgtcctcaagaatccaacaagcatcttcttcatcctggtcctgcccccagctgagtccagcgttaaatgttcttaaaggacttctagggtcctgtgggctccaagcccagcctggctcttcactttggtcttggaagaaggcctcagcatcctcttcctcaccatcagtgagcagcagcagctcctcatggggcaaatggagatccccactctcttcattcacctcactggattccaccacaatagacggcagatgggacttttgagagaaatcctccgtgggcgccggaccttggcttgggcgcaggaatccgaggcagcctttctccttcgtgggcccagcggagagtccggaccgagataccatgccaggactctccggggtcctgtgagctgccgtcgggtgagcacgtttcccccaaaccctggactgactgctttaaggtccgcaaggcgggccagggccgagacgcgagtcggatgtggtgaactgaaagaaccaataaaatcatgttcctccacc

SEQ ID NO: 286700 - DNA, 3131 bp, Homo sapiens
aggcaaccggcgccagccatggcctctggggcgggcggaagctggggtcgctccccaccgcagagcgcagtcccgacgccctgggtcaccttcctgcagcccctctcgtgggccgtcccacctgcgcccccgcagccaggccgcgtgaaggaagacctgctggaactgatgatgctgcagaacgcgcagatgcaccagctgctgctgagtcgcctggtggctggagcgctgcagccccggcctgcctcgccctgccctcaggtctacctggaggttccacaggaagagcctgaggaggaggaggaggagatggacgtgcgggagaaagggcctttggtgtttcaccaccactacttgccctatttgatgccctccccgggtgccctgctgccctggccagcccccttcttccccacccctgcttgtcagccctacttgcaggacgtgcccagcattcagcactgtcctgcctccagggaaagggaggtgagagctgtgcccccacccccaccccccagtgccacagggactgtgggtgctgatgtacccccggcttcagactactatgatgccgagagcctcctatgaggacagaccccggccctgggaactgcaccagcttcctgctctggatacagccccggagccgcctcctgcacctctcttgtcgactccccggtgcccatggctggcagtccttctcactccctcaacctcagccaggccctcttctcctggggaaatcagtccctgccccacgccaatgagttcctggacgggccggatctgtgctgttgtgtaagagctccctagagcaccacccaggcccttgaagccacgtcagcccgcctctgccccactgcttcctgcctggagcagggggaggcctgggaacagagcccccaccctctctccctcacccctctctctgggatgatgaggtctccttccagcctagtaatggagcaagaggggagggggggattccttctgctttccacagctttgaaggcccctttgaggtggctggaggggcccagagtggtcggggagagactttgctgggcagcgcccctgagcagagtcagttcgctgggccccccacccctcatcccaggaagcagctctgttggcagaaaggagaggtcagagctttgtcctgctgtggccaggagtggcctgaggtctcctggggccaggtgggaacagtgtgtcctctgccccctgggccagggtgtgtttcccccaccctccctcagtagcaatgagctactcgggccagatgggggcctgttgcatgggctgggaggcccctgtgaaggagagggtggggagggaggcatctagggagaggggtcccccatggtggctcccctccctggccattgttatcccaggaggagacactgtgggcacagggctaagtccaggtgtttgtattcgggctagaaaaggcaatgtcccaagtctctgctgcctgtcacagtccttcagccagggctggacctcaaccctgaggagtcacactgagttccagtgaccaccgtggtggtggccatgccactcatggttgctatggccggaaggcctggggcagcctcctccaagccgctcgcaccccgtaggtgcccatccgctgctggcgcaagtgctggccgaagatgaagcagagcaggacagatgtcacgaacagggacagcaacaccgacaccaccgtgactatgatgaccatctggctgtccgacacaggctctggggagggagggggcaagggtcttagacgtcctgtgatcccagttaccagggaccaaaagggagtggaagtccacccccaacccagacccccagaccccgccgcccgctcatgcatccagcagtcaccccagttgcagagatgagtggtgaatggtgtctgcattaaaattattatctggaaaaaaggtggcccagggctcaggctaccagctggacttctgtgtggctgtgagggcagatgtccccttgtcagcagccatgggaccagtgtgtagctgctggacaccgtggcctggagggtggcatggtcccagccaagccccttcttgggcagagctgagtgaacttcatgccaggctccctgtgtgccggccgtccagagtcaccaagcagcagagctctggggacctcagtgggggcagtcaggccaaacttctcattgtggaggggagccaaggccagggagagccgtcaaggtcatggggcttgatggtggccgaggaactagttgacctctcccgacctctggagcagttgaggtccaagctggggacttggaaagaacttcagggaagagggagagtaagagggaagcctcaggatgaagggtgggctcctgggtgtttgcttcccaagtgggactcaagatttttcttcccccgaggggctgaaagtgacttctcactcccaactccatccacggatcccccctcaccatagatctccaacatcttcggggctgagtgtttgtgaaagatgttgccaccgcgagacatcaagtccagcacagccaggcaggagaagttgcggtggccatcctctctgtcagccgtgctgttgaatgtggctgtggcctcctgcggagcaggggctgccttcccgaaggtctcatagtgcagagtctcattgccacggaacaggaagagggtgaggctgtccaggggctccacggtgggcaccctgcactcaatggtgaaggacttgcccacagccaccaaagtgggttgcagtgtcaggatgacctgccttggaggctctgcaggggacaaaggagggaggtctggtcaggatgggggtgcagtcccagcagcctccccctggccagggccatctcctgtcaccatggtgttccacggttggggaggaggtggcctggccggctccagtgcagagaggaagagggcggcagttgaggatggaggctggactgtgtggtagttttacagacatgatggtttccggtgaccaggtgtctacaaggacaaggttcagaaattgtacagccaactggaaagatataaaagtttgggtctgtctcctctccttcagaaatgaaatataaatttcaaacattaaacagttgggtgatcacgttg

SEQ ID NO: 286701 - DNA, 3312 bp, Homo sapiens
gagcggcttagcttgggagacggcagagtggggagctgtccctggaggggccagatccttgaggggtgggggacgaggagagacagccccaaaccgagaggaagaggcgtggcagggagcagggaggccacggggcggggaggagagaacctggcccctgcggggttagggaggccactggccgggaggggttggggctcgcgacgtgtccccatccattcccgccaccggacctggctgagtccgcgcacacccccagccctgggtcaccttcctgcagcccctctcgtgggccgtcccacctgcgcccccgcagccaggccgcgtgaaggaagacctgctggaactgatgatgctgcagaacgcgcagatgcaccagctgctgctgagtcgcctggtggctggagcgctgcagccccggcctgcctcgccctgccctcaggtctacctggaggttccacaggaagagcctgaggaggaggaggaggagatggacgtgcgggagaaagggcctttggtgtttcaccaccactacttgccctatttgatgccctccccgggtgccctgctgccctggccagcccccttcttccccacccctgcttgtcagccctacttgcaggacgtgcccagcattcagcactgtcctgcctccagggaaagggaggtgagagctgtgcccccacccccaccccccagtgccacagggactgtgggtgctgatgtacccccggcttcagactactatgatgccgagagcctcctatgaggacagaccccggccctgggaactgcaccagcttcctgctctggatacagccccggagccgcctcctgcacctctcttgtcgactccccggtgcccatggctggcagtccttctcactccctcaacctcagccaggccctcttctcctggggaaatcagtccctgccccacgccaatgagttcctggacgggccggatctgtgctgttgtgtaagagctccctagagcaccacccaggcccttgaagccacgtcagcccgcctctgccccactgcttcctgcctggagcagggggaggcctgggaacagagcccccaccctctctccctcacccctctctctgggatgatgaggtctccttccagcctagtaatggagcaagaggggagggggggattccttctgctttccacagctttgaaggcccctttgaggtggctggaggggcccagagtggtcggggagagactttgctgggcagcgcccctgagcagagtcagttcgctgggccccccacccctcatcccaggaagcagctctgttggcagaaaggagaggtcagagctttgtcctgctgtggccaggagtggcctgaggtctcctggggccaggtgggaacagtgtgtcctctgccccctgggccagggtgtgtttcccccaccctccctcagtagcaatgagctactcgggccagatgggggcctgttgcatgggctgggaggcccctgtgaaggagagggtggggagggaggcatctagggagaggggtcccccatggtggctcccctccctggccattgttatcccaggaggagacactgtgggcacagggctaagtccaggtgtttgtattcgggctagaaaaggcaatgtcccaagtctctgctgcctgtcacagtccttcagccagggctggacctcaaccctgaggagtcacactgagttccagtgaccaccgtggtggtggccatgccactcatggttgctatggccggaaggcctggggcagcctcctccaagccgctcgcaccccgtaggtgcccatccgctgctggcgcaagtgctggccgaagatgaagcagagcaggacagatgtcacgaacagggacagcaacaccgacaccaccgtgactatgatgaccatctggctgtccgacacaggctctggggagggagggggcaagggtcttagacgtcctgtgatcccagttaccagggaccaaaagggagtggaagtccacccccaacccagacccccagaccccgccgcccgctcatgcatccagcagtcaccccagttgcagagatgagtggtgaatggtgtctgcattaaaattattatctggaaaaaaggtggcccagggctcaggctaccagctggacttctgtgtggctgtgagggcagatgtccccttgtcagcagccatgggaccagtgtgtagctgctggacaccgtggcctggagggtggcatggtcccagccaagccccttcttgggcagagctgagtgaacttcatgccaggctccctgtgtgccggccgtccagagtcaccaagcagcagagctctggggacctcagtgggggcagtcaggccaaacttctcattgtggaggggagccaaggccagggagagccgtcaaggtcatggggcttgatggtggccgaggaactagttgacctctcccgacctctggagcagttgaggtccaagctggggacttggaaagaacttcagggaagagggagagtaagagggaagcctcaggatgaagggtgggctcctgggtgtttgcttcccaagtgggactcaagatttttcttcccccgaggggctgaaagtgacttctcactcccaactccatccacggatcccccctcaccatagatctccaacatcttcggggctgagtgtttgtgaaagatgttgccaccgcgagacatcaagtccagcacagccaggcaggagaagttgcggtggccatcctctctgtcagccgtgctgttgaatgtggctgtggcctcctgcggagcaggggctgccttcccgaaggtctcatagtgcagagtctcattgccacggaacaggaagagggtgaggctgtccaggggctccacggtgggcaccctgcactcaatggtgaaggacttgcccacagccaccaaagtgggttgcagtgtcaggatgacctgccttggaggctctgcaggggacaaaggagggaggtctggtcaggatgggggtgcagtcccagcagcctccccctggccagggccatctcctgtcaccatggtgttccacggttggggaggaggtggcctggccggctccagtgcagagaggaagagggcggcagttgaggatggaggctggactgtgtggtagttttacagacatgatggtttccggtgaccaggtgtctacaaggacaaggttcagaaattgtacagccaactggaaagatataaaagtttgggtctgtctcctctccttcagaaatgaaatataaatttcaaacattaaacagttgggtgatcacgttg

SEQ ID NO: 286702 - DNA, 2304 bp, Homo sapiens
aggcaaccggcgccagccatggcctctggggcgggcggaagctggggtcgctccccaccgcagagcgcagtcccgacgccctgggtcaccttcctgcagcccctctcgtgggccgtcccacctgcgcccccgcagccaggccgcgtgaaggaagacctgctggaactgatgatgctgcagaacgcgcagatgcaccagctgctgctgagtcgcctggtggctggagcgctgcagccccggcctgcctcgccctgccctcaggtctacctggaggttccacaggaagagcctgaggaggaggaggaggagatggacgtgcgggagaaagggcctttggtgtttcaccaccactacttgccctatttgatgccctccccgggtgccctgctgccctggccagcccccttcttccccacccctgcttgtcagccctacttgcaggacgtgcccagcattcagcactgtcctgcctccagggaaagggaggtgagagctgtgcccccacccccaccccccagtgccacagggactgtgggtgctgatgtacccccggcttcagactactatgatgccgagagcctcctatgaggacagaccccggccctgggaactgcaccagcttcctgctctggatacagccccggagccgcctcctgcacctctcttgtcgactccccggtgcccatggctggcagtccttctcactccctcaacctcagccaggccctcttctcctggggaaatcagtccctgccccacgccaatgagttcctggacgggccggatctgtgctgttgtgtgcccatccgctgctggcgcaagtgctggccgaagatgaagcagagcaggacagatgtcacgaacagggacagcaacaccgacaccaccgtgactatgatgaccatctggctgtccgacacaggctctggggagggagggggcaagggtcttagacgtcctgtgatcccagttaccagggaccaaaagggagtggaagtccacccccaacccagacccccagaccccgccgcccgctcatgcatccagcagtcaccccagttgcagagatgagtggtgaatggtgtctgcattaaaattattatctggaaaaaaggtggcccagggctcaggctaccagctggacttctgtgtggctgtgagggcagatgtccccttgtcagcagccatgggaccagtgtgtagctgctggacaccgtggcctggagggtggcatggtcccagccaagccccttcttgggcagagctgagtgaacttcatgccaggctccctgtgtgccggccgtccagagtcaccaagcagcagagctctggggacctcagtgggggcagtcaggccaaacttctcattgtggaggggagccaaggccagggagagccgtcaaggtcatggggcttgatggtggccgaggaactagttgacctctcccgacctctggagcagttgaggtccaagctggggacttggaaagaacttcagggaagagggagagtaagagggaagcctcaggatgaagggtgggctcctgggtgtttgcttcccaagtgggactcaagatttttcttcccccgaggggctgaaagtgacttctcactcccaactccatccacggatcccccctcaccatagatctccaacatcttcggggctgagtgtttgtgaaagatgttgccaccgcgagacatcaagtccagcacagccaggcaggagaagttgcggtggccatcctctctgtcagccgtgctgttgaatgtggctgtggcctcctgcggagcaggggctgccttcccgaaggtctcatagtgcagagtctcattgccacggaacaggaagagggtgaggctgtccaggggctccacggtgggcaccctgcactcaatggtgaaggacttgcccacagccaccaaagtgggttgcagtgtcaggatgacctgccttggaggctctgcaggggacaaaggagggaggtctggtcaggatgggggtgcagtcccagcagcctccccctggccagggccatctcctgtcaccatggtgttccacggttggggaggaggtggcctggccggctccagtgcagagaggaagagggcggcagttgaggatggaggctggactgtgtggtagttttacagacatgatggtttccggtgaccaggtgtctacaaggacaaggttcagaaattgtacagccaactggaaagatataaaagtttgggtctgtctcctctccttcagaaatgaaatataaatttcaaacattaaacagttgggtgatcacgttg

SEQ ID NO: 286703 - DNA, 273 bp, Homo sapiens
gccaggatggtctcaatctcctgaccttgtgatccgcccgcctcggcctcccacagtgctgggattacaggcgtgagccaccatgcctggccacaagccattcttacaaagcctatctggaggaaataacttaggggaatggaggagtggcggtggggagagcctgatggtagattctcatttcccctccctgttttgcacaatccccaggtctacctggaggttccacaggaagagcctgaggaggaggaggaggagatggacgtgcgggag

SEQ ID NO: 286704 - DNA, 827 bp, Homo sapiens
aggcaactggcctgtccccttccctttacctctttggggtccactgagacaggagggagtcaagatgaggttcttgtttccccagactactatgatgccgagagcctcctatgaggacagaccccggccctgggaactgcaccagcttcctgctctggatacagccccggagccgcctcctgcacctctcttgtcgactccccggtgcccatggctggcagtccttctcactccctcaacctcagccaggccctcttctcctggggaaatcagtccctgccccacgccaatgagttcctggacgggccggatctgtgctgttgtgtaagagctccctagagcaccacccaggcccttgaagccacgtcagcccgcctctgccccactgcttcctgcctggagcagggggaggcctgggaacagagcccccaccctctctccctcacccctctctctgggatgatgaggtctccttccagcctagtaatggagcaagaggggagggggggattccttctgctttccacagctttgaaggcccctttgaggtggctggaggggcccagagtggtcggggagagactttgctgggcagcgcccctgagcagagtcagttcgctgggccccccacccctcatcccaggaagcagctctgttggcagaaaggagaggtcagagctttgtcctgctgtggccaggagtggcctgaggtctcctggggccaggtgggaacagtgtgtcctctgccccctgggccagggtgtgtttcccccaccctccctcagtagcaatgagctactcgggccagatgggggcctgttgcatgg

SEQ ID NO: 286705 - DNA, 831 bp, Homo sapiens
aacattttattagtttttttaatacagagaaaagacctcaaaaaaagttttttttttaaagctacatttcaaacagtatgcaaaggtacaattgaaaagtatgcagcatccttctcccagctgacaattggttcagtttcttgtgattacatccagaaaggggaacataaaaacttctaagtctgtaccagcataatgtctgttgatatattttttaagtatacgcagaaaggatctttctatttatacgctatagtgtgtataccttaccctggtaatagaccacatttggttttgattcatcttacaaaatcatatgttagttcataaagttaatgaatgagtactctttgcttttaacatctttttcaggttggtacccggaggtacatggctccagaggtattagagggtgctataaacttccaaagggatgcatttttgaggatagatatgtatgccatgggattagtcctatgggaactggcttctcgctgtactgctgcagatggtaagggaaaaaaatatttttaaaaaagatatatatgcctaccacacatatatgaaaagggatgatacactccaaggtaatattttaaagtacagtttttttttaattgactccaagagatggtagagaattcaggaggcaggggagcagtgggtggggtaggagaggaaaggaattgctatgtattgatcctttaccattactagctatgttgctggacacttcacataccttaaggttatttcctaaaacggtttcagaggtagttattatgctttacatatgaggaaattgagatgcagagaaattaagtagtttgc

SEQ ID NO: 286706 - DNA, 4228 bp, Homo sapiens
ttttttttggtctgggcttccgaatatgttttatgacggttgattttacaccaggaggtttgtctccgaggaagacccagggaactggatatctagcgagaacttcctccggattccccggcgcctcgggaaaatgggagctgctgcaaagttggcgtttgccgtctttcttatctcctgttcttcaggtgctatacttggtagatcagaaactcaggagtgtcttttctttaatgctaattgggaaaaagacagaaccaatcaaactggtgttgaaccgtgttatggtgacaaagataaacggcggcattgttttgctacctggaagaatatttctggttccattgaaatagtgaaacaaggttgttggctggatgatatcaactgctatgacaggactgattgtgtagaaaaaaaagacagccctgaagtatatttttgttgctgtgagggcaatatgtgtaatgaaaagttttcttattttccggagatggaagtcacacagcccacttcaaatccagttacacctaagccaccctattacaacatcctgctctattccttggtgccacttatgttaattgcggggattgtcatttgtgcattttgggtgtacaggcatcacaagatggcctaccctcctgtacttgttccaactcaagacccaggaccacccccaccttctccattactaggtttgaaaccactgcagttattagaagtgaaagcaaggggaagatttggttgtgtctggaaagcccagttgcttaacgaatatgtggctgtcaaaatatttccaatacaggacaaacagtcatggcaaaatgaatacgaagtctacagtttgcctggaatgaagcatgagaacatattacagttcattggtgcagaaaaacgaggcaccagtgttgatgtggatctttggctgatcacagcatttcatgaaaagggttcactatcagactttcttaaggctaatgtggtctcttggaatgaactgtgtcatattgcagaaaccatggctagaggattggcatatttacatgaggatatacctggcctaaaagatggccacaaacctgccatatctcacagggacatcaaaagtaaaaatgtgctgttgaaaaacaacctgacagcttgcattgctgactttgggttggccttaaaatttgaggctggcaagtctgcaggcgatacccatggacaggttggtacccggaggtacatggctccagaggtattagagggtgctataaacttccaaagggatgcatttttgaggatagatatgtatgccatgggattagtcctatgggaactggcttctcgctgtactgctgcagatggacctgtagatgaatacatgttgccatttgaggaggaaattggccagcatccatctcttgaagacatgcaggaagttgttgtgcataaaaaaaagaggcctgttttaagagattattggcagaaacatgctggaatggcaatgctctgtgaaaccattgaagaatgttgggatcacgacgcagaagccaggttatcagctggatgtgtaggtgaaagaattacccagatgcagagactaacaaatattattaccacagaggacattgtaacagtggtcacaatggtgacaaatgttgactttcctcccaaagaatctagtctatgatggttgcgccatctgtgcacactaagaaatgggactctgaactggagctgctaagctaaagaaactgcttacagtttattttctgtgtaaaatgagtaggatgtctcttggaaatgttaagaaagaagaccctttgttgaaaaatgttgctctgggagacttactgcattgccgacagcacagatgtgaaggacatgagactaagagaaaccttgcaaactctataaagaaacttttgaaaaagtgtacatgaagaatgtagccctctccaaatcaaggatcttttggacctggctaatggagtgtttgaaaactgacatcagatttcttaatgtctgtcagaagacactaattccttaaatgaactactgctattttttttaaatcaaaaacttttcatttcagattttaaaaagggtaacttgtttttattgcatttgctgttgtttctataaatgactattgtaatgccaatatgacacagcttgtgaatgtttagtgtgctgctgttctgtgtacataaagtcatcaaagtggggtacagtaaagaggcttccaagcattactttaacctccctcaacaaggtatacctcagttccacggttgctaaattataaaattgaaaacactaacaaaatttgaataataaatcgatccatgttttgtaacaaattcactgtgttatttaaggaaaaaaaggtaagctatgcttagtgccaacaataagtggccattcgtaaagcagtgttttagcatttcttgtgctggcttgtaatgtagggaaaaaaagtgctgttttttgaaaagatggtgtcatttcccccttcttcccatgttttaaagccccatcttatatccagttcccaaaatttgcatacttacctaagtattttttttaggtgtgctgtgtttggggaatatttgaaaatttaaagcatgatttaaaattttttaaagtgagctgtgacactggaaagctcttcattttatcttttaaaatagagttttttctatttatatatgtaaaattgtagtgtatttcttttcaccaaacagtgtgtgggacattctttatcactgttttaggatcacctcaggaagtgtcgttacccagaattccccactgtctgctatgagacttgtaactttatcactatacttctgcttggtgccatcttgtcagagtaatatttgatgtctgtgatatgtaaagaattatcctaggataaagatattaaactttaagcagatttcagatgttactgctttaaaacaaatcagggataacaaattaaacgtataacttaaaatatgcaatgacatttagaggtaaccaatgttgatataggtagcatagcctagcctcctccccaaaattgcttttacaactaacactgatactaatttaggatagttcatgccttatccttgctaagaaaatggaattgatggtaggcaggtgctaaagtgcttttcaaaacaatattacgttagaatacaattggattcttcctcaaatttatacaggccaaaaagtaaaacattaattttctgaatttccagattaccaatcaattaatcaacaaatagccagtattatgctgtgtatttctgtcaggtcattttaaaatccatgttaattttataaaagaattttttacatgtcactgtcaggagctcactgtgaatgtgttgtcttcaaatggttatttaaccacacagtacactacattttacatatatgtacgtaatctctgggaatagtaaattaattatgttatttataaacaatacataggtcaacagactttaagcagggaggaaaagaagagtaatagcgtctgtgtgctgcagaccattcagaactgtcacgtgtgtccccatggtctcattcattgtattcctagcaattcccttttcaatgttgagttcacctctttatttcacaaagtacttggtctctcaatttcttgatctggttttgcttccatttaaaaactaatcaagaagggaaaatattgagaatgtgcatacaagaaaatcattaatttcctgaagatgaatttctacctgttgtgaacatttaactttctttttaaaagttaaacaaaaataaacaagggatattatgatgaatgtttggcttatgtgagtactagagataaaatttttaaacccagttattcacaatataaaatgttttcaagttagaaaaaatttttagaaatcctgggtattgtatttaactgtagctaaccaattttaaaacttgtattcttttgagaactattattaatagaaaaactttttataagcagtaaaataagaatgttccagtgactacctgtccttatacctagtcttgttaaaactttcttttgcagggtatttagtgtttggtttacagtcagtgcagagtgggcaagttaacagaaagtttgagctagagatactggaaaaaaaaaagatcaaagaatgagaaaaatggtgatccattttggggcaaactgagaccccccaaataactctttcctcatgtgtatggtgctcct

SEQ ID NO: 286707 - DNA, 4359 bp, Homo sapiens
accgaaaacgcggccgagcccggagcccggagctggagccagagcctggaccagaacttggccgccgcctgcaccgccgccgccgctgccgcccgccgccccttccccgcgccgcagccgcctcgccgccaccgccgcgagctcggccgccagtggtcctcggactttaggtgtctgggttgaaggaggtttgtctccgaggaagacccagggaactggatatctagcgagaacttcctccggattccccggcgcctcgggaaaatgggagctgctgcaaagttggcgtttgccgtctttcttatctcctgttcttcaggtgctatacttggtagatcagaaactcaggagtgtcttttctttaatgctaattgggaaaaagacagaaccaatcaaactggtgttgaaccgtgttatggtgacaaagataaacggcggcattgttttgctacctggaagaatatttctggttccattgaaatagtgaaacaaggttgttggctggatgatatcaactgctatgacaggactgattgtgtagaaaaaaaagacagccctgaagtatatttttgttgctgtgagggcaatatgtgtaatgaaaagttttcttattttccggagatggaagtcacacagcccacttcaaatccagttacacctaagccaccctattacaacatcctgctctattccttggtgccacttatgttaattgcggggattgtcatttgtgcattttgggtgtacaggcatcacaagatggcctaccctcctgtacttgttccaactcaagacccaggaccacccccaccttctccattactaggtttgaaaccactgcagttattagaagtgaaagcaaggggaagatttggttgtgtctggaaagcccagttgcttaacgaatatgtggctgtcaaaatatttccaatacaggacaaacagtcatggcaaaatgaatacgaagtctacagtttgcctggaatgaagcatgagaacatattacagttcattggtgcagaaaaacgaggcaccagtgttgatgtggatctttggctgatcacagcatttcatgaaaagggttcactatcagactttcttaaggctaatgtggtctcttggaatgaactgtgtcatattgcagaaaccatggctagaggattggcatatttacatgaggatatacctggcctaaaagatggccacaaacctgccatatctcacagggacatcaaaagtaaaaatgtgctgttgaaaaacaacctgacagcttgcattgctgactttgggttggccttaaaatttgaggctggcaagtctgcaggcgatacccatggacaggttggtacccggaggtacatggctccagaggtattagagggtgctataaacttccaaagggatgcatttttgaggatagatatgtatgccatgggattagtcctatgggaactggcttctcgctgtactgctgcagatggacctgtagatgaatacatgttgccatttgaggaggaaattggccagcatccatctcttgaagacatgcaggaagttgttgtgcataaaaaaaagaggcctgttttaagagattattggcagaaacatgctggaatggcaatgctctgtgaaaccattgaagaatgttgggatcacgacgcagaagccaggttatcagctggatgtgtaggtgaaagaattacccagatgcagagactaacaaatattattaccacagaggacattgtaacagtggtcacaatggtgacaaatgttgactttcctcccaaagaatctagtctatgatggttgcgccatctgtgcacactaagaaatgggactctgaactggagctgctaagctaaagaaactgcttacagtttattttctgtgtaaaatgagtaggatgtctcttggaaatgttaagaaagaagaccctttgttgaaaaatgttgctctgggagacttactgcattgccgacagcacagatgtgaaggacatgagactaagagaaaccttgcaaactctataaagaaacttttgaaaaagtgtacatgaagaatgtagccctctccaaatcaaggatcttttggacctggctaatggagtgtttgaaaactgacatcagatttcttaatgtctgtcagaagacactaattccttaaatgaactactgctattttttttaaatcaaaaacttttcatttcagattttaaaaagggtaacttgtttttattgcatttgctgttgtttctataaatgactattgtaatgccaatatgacacagcttgtgaatgtttagtgtgctgctgttctgtgtacataaagtcatcaaagtggggtacagtaaagaggcttccaagcattactttaacctccctcaacaaggtatacctcagttccacggttgctaaattataaaattgaaaacactaacaaaatttgaataataaatcgatccatgttttgtaacaaattcactgtgttatttaaggaaaaaaaggtaagctatgcttagtgccaacaataagtggccattcgtaaagcagtgttttagcatttcttgtgctggcttgtaatgtagggaaaaaaagtgctgttttttgaaaagatggtgtcatttcccccttcttcccatgttttaaagccccatcttatatccagttcccaaaatttgcatacttacctaagtattttttttaggtgtgctgtgtttggggaatatttgaaaatttaaagcatgatttaaaattttttaaagtgagctgtgacactggaaagctcttcattttatcttttaaaatagagttttttctatttatatatgtaaaattgtagtgtatttcttttcaccaaacagtgtgtgggacattctttatcactgttttaggatcacctcaggaagtgtcgttacccagaattccccactgtctgctatgagacttgtaactttatcactatacttctgcttggtgccatcttgtcagagtaatatttgatgtctgtgatatgtaaagaattatcctaggataaagatattaaactttaagcagatttcagatgttactgctttaaaacaaatcagggataacaaattaaacgtataacttaaaatatgcaatgacatttagaggtaaccaatgttgatataggtagcatagcctagcctcctccccaaaattgcttttacaactaacactgatactaatttaggatagttcatgccttatccttgctaagaaaatggaattgatggtaggcaggtgctaaagtgcttttcaaaacaatattacgttagaatacaattggattcttcctcaaatttatacaggccaaaaagtaaaacattaattttctgaatttccagattaccaatcaattaatcaacaaatagccagtattatgctgtgtatttctgtcaggtcattttaaaatccatgttaattttataaaagaattttttacatgtcactgtcaggagctcactgtgaatgtgttgtcttcaaatggttatttaaccacacagtacactacattttacatatatgtacgtaatctctgggaatagtaaattaattatgttatttataaacaatacataggtcaacagactttaagcagggaggaaaagaagagtaatagcgtctgtgtgctgcagaccattcagaactgtcacgtgtgtccccatggtctcattcattgtattcctagcaattcccttttcaatgttgagttcacctctttatttcacaaagtacttggtctctcaatttcttgatctggttttgcttccatttaaaaactaatcaagaagggaaaatattgagaatgtgcatacaagaaaatcattaatttcctgaagatgaatttctacctgttgtgaacatttaactttctttttaaaagttaaacaaaaataaacaagggatattatgatgaatgtttggcttatgtgagtactagagataaaatttttaaacccagttattcacaatataaaatgttttcaagttagaaaaaatttttagaaatcctgggtattgtatttaactgtagctaaccaattttaaaacttgtattcttttgagaactattattaatagaaaaactttttataagcagtaaaataagaatgttccagtgactacctgtccttatacctagtcttgttaaaactttcttttgcagggtatttagtgtttggtttacagtcagtgcagagtgggcaagttaacagaaagtttgagctagagatactggaaaaaaaaaagatcaaagaatgagaaaaatggtgatccattttggggcaaactgagaccccccaaataactctttcctcatgtgtatggtgctcct

SEQ ID NO: 286708 - DNA, 545 bp, Homo sapiens
ttttttttggtctgggcttccgaatatgttttatgacggttgattttacaccaggaggtttgtctccgaggaagacccagggaactggatatctagcgagaacttcctccggattccccggcgcctcgggaaaatgggagctgctgcaaagttggcgtttgccgtctttcttatctcctgttcttcaggtgctatacttggtagatcagaaactcaggagtgtcttttctttaatgctaattgggaaaaagacagaaccaatcaaactggtgttgaaccgtgttatggtgacaaagataaacggcggcattgttttgctacctggaagaatatttctggttccattgaaatagtgaaacaaggttgttggctggatgatatcaactgctatgacaggtaagaacacatttaagattttatggtagtattgagtaattttcacacttcccctctttttgaaaggggaaagatcagtgcataaattttcacttaaatgtttcttgctttttaaaaaatgggattataaagaacattataacatgctg

SEQ ID NO: 286709 - DNA, 487 bp, Homo sapiens
atgggtaccttaaagggatattatataacgttaatttacaaatactgattgttccttatgtcctctgtgcagatggaaataggcatcctttatacctagataagaaagccccttatgcaatctttaagggaattacatgccaaattataggccttttcatttcccatacattagtttggtcacactgtggtataagtacagttgagagtctgtttctcttctgtcctcatagcatgtaaacagttgggaataggtgacagagtatattttagaaagtttgtaccagtttgaaagtcaggaggattttaatgaaaatgatttattttacttttcttacttttcaggacctgtagatgaatacatgttgccatttgaggaggaaattggccagcatccatctcttgaagacatgcaggaagttgttgtgcataaaagtacaggcaagcttcttttttttttttttcacttccttacctctcttttcttt

SEQ ID NO: 286710 - DNA, 345 bp, Homo sapiens
accgaaaacgcggccgagcccggagcccggagctggagccagagcctggaccagaacttggccgccgcctgcaccgccgccgccgctgccgcccgccgccccttccccgcgccgcagccgcctcgccgccaccgccgcgagctcggccgccagtggtcctcggactttaggtgtctgggttgaaggtcggtccggacatcggacccagtcagttcccagactgtccgggcggcagcggacgccgctgccgccgccgcctcttcgtcgcctcagcctggcgttttgttccgagagacgggagaggcgagcggagctgacagtgattttgacagtgatttaaacccg

SEQ ID NO: 286711 - DNA, 4315 bp, Homo sapiens
accgaaaacgcggccgagcccggagcccggagctggagccagagcctggaccagaacttggccgccgcctgcaccgccgccgccgctgccgcccgccgccccttccccgcgccgcagccgcctcgccgccaccgccgcgagctcggccgccagtggtcctcggactttaggtgtctgggttgaaggtgctatacttggtagatcagaaactcaggagtgtcttttctttaatgctaattgggaaaaagacagaaccaatcaaactggtgttgaaccgtgttatggtgacaaagataaacggcggcattgttttgctacctggaagaatatttctggttccattgaaatagtgaaacaaggttgttggctggatgatatcaactgctatgacaggatagtaagagaagtaagaggaaaagaagattcaagaattgtcaaagtgtggaagacaagaaaatgataaaagaagaatgaaattgaatggactgattgtgtagaaaaaaaagacagccctgaagtatatttttgttgctgtgagggcaatatgtgtaatgaaaagttttcttattttccggagatggaagtcacacagcccacttcaaatccagttacacctaagccaccctattacaacatcctgctctattccttggtgccacttatgttaattgcggggattgtcatttgtgcattttgggtgtacaggcatcacaagatggcctaccctcctgtacttgttccaactcaagacccaggaccacccccaccttctccattactaggtttgaaaccactgcagttattagaagtgaaagcaaggggaagatttggttgtgtctggaaagcccagttgcttaacgaatatgtggctgtcaaaatatttccaatacaggacaaacagtcatggcaaaatgaatacgaagtctacagtttgcctggaatgaagcatgagaacatattacagttcattggtgcagaaaaacgaggcaccagtgttgatgtggatctttggctgatcacagcatttcatgaaaagggttcactatcagactttcttaaggctaatgtggtctcttggaatgaactgtgtcatattgcagaaaccatggctagaggattggcatatttacatgaggatatacctggcctaaaagatggccacaaacctgccatatctcacagggacatcaaaagtaaaaatgtgctgttgaaaaacaacctgacagcttgcattgctgactttgggttggccttaaaatttgaggctggcaagtctgcaggcgatacccatggacaggttggtacccggaggtacatggctccagaggtattagagggtgctataaacttccaaagggatgcatttttgaggatagatatgtatgccatgggattagtcctatgggaactggcttctcgctgtactgctgcagatggacctgtagatgaatacatgttgccatttgaggaggaaattggccagcatccatctcttgaagacatgcaggaagttgttgtgcataaaaaaaagaggcctgttttaagagattattggcagaaacatgctggaatggcaatgctctgtgaaaccattgaagaatgttgggatcacgacgcagaagccaggttatcagctggatgtgtaggtgaaagaattacccagatgcagagactaacaaatattattaccacagaggacattgtaacagtggtcacaatggtgacaaatgttgactttcctcccaaagaatctagtctatgatggttgcgccatctgtgcacactaagaaatgggactctgaactggagctgctaagctaaagaaactgcttacagtttattttctgtgtaaaatgagtaggatgtctcttggaaatgttaagaaagaagaccctttgttgaaaaatgttgctctgggagacttactgcattgccgacagcacagatgtgaaggacatgagactaagagaaaccttgcaaactctataaagaaacttttgaaaaagtgtacatgaagaatgtagccctctccaaatcaaggatcttttggacctggctaatggagtgtttgaaaactgacatcagatttcttaatgtctgtcagaagacactaattccttaaatgaactactgctattttttttaaatcaaaaacttttcatttcagattttaaaaagggtaacttgtttttattgcatttgctgttgtttctataaatgactattgtaatgccaatatgacacagcttgtgaatgtttagtgtgctgctgttctgtgtacataaagtcatcaaagtggggtacagtaaagaggcttccaagcattactttaacctccctcaacaaggtatacctcagttccacggttgctaaattataaaattgaaaacactaacaaaatttgaataataaatcgatccatgttttgtaacaaattcactgtgttatttaaggaaaaaaaggtaagctatgcttagtgccaacaataagtggccattcgtaaagcagtgttttagcatttcttgtgctggcttgtaatgtagggaaaaaaagtgctgttttttgaaaagatggtgtcatttcccccttcttcccatgttttaaagccccatcttatatccagttcccaaaatttgcatacttacctaagtattttttttaggtgtgctgtgtttggggaatatttgaaaatttaaagcatgatttaaaattttttaaagtgagctgtgacactggaaagctcttcattttatcttttaaaatagagttttttctatttatatatgtaaaattgtagtgtatttcttttcaccaaacagtgtgtgggacattctttatcactgttttaggatcacctcaggaagtgtcgttacccagaattccccactgtctgctatgagacttgtaactttatcactatacttctgcttggtgccatcttgtcagagtaatatttgatgtctgtgatatgtaaagaattatcctaggataaagatattaaactttaagcagatttcagatgttactgctttaaaacaaatcagggataacaaattaaacgtataacttaaaatatgcaatgacatttagaggtaaccaatgttgatataggtagcatagcctagcctcctccccaaaattgcttttacaactaacactgatactaatttaggatagttcatgccttatccttgctaagaaaatggaattgatggtaggcaggtgctaaagtgcttttcaaaacaatattacgttagaatacaattggattcttcctcaaatttatacaggccaaaaagtaaaacattaattttctgaatttccagattaccaatcaattaatcaacaaatagccagtattatgctgtgtatttctgtcaggtcattttaaaatccatgttaattttataaaagaattttttacatgtcactgtcaggagctcactgtgaatgtgttgtcttcaaatggttatttaaccacacagtacactacattttacatatatgtacgtaatctctgggaatagtaaattaattatgttatttataaacaatacataggtcaacagactttaagcagggaggaaaagaagagtaatagcgtctgtgtgctgcagaccattcagaactgtcacgtgtgtccccatggtctcattcattgtattcctagcaattcccttttcaatgttgagttcacctctttatttcacaaagtacttggtctctcaatttcttgatctggttttgcttccatttaaaaactaatcaagaagggaaaatattgagaatgtgcatacaagaaaatcattaatttcctgaagatgaatttctacctgttgtgaacatttaactttctttttaaaagttaaacaaaaataaacaagggatattatgatgaatgtttggcttatgtgagtactagagataaaatttttaaacccagttattcacaatataaaatgttttcaagttagaaaaaatttttagaaatcctgggtattgtatttaactgtagctaaccaattttaaaacttgtattcttttgagaactattattaatagaaaaactttttataagcagtaaaataagaatgttccagtgactacctgtccttatacctagtcttgttaaaactttcttttgcagggtatttagtgtttggtttacagtcagtgcagagtgggcaagttaacagaaagtttgagctagagatactggaaaaaaaaaagatcaaagaatgagaaaaatggtgatccattttggggcaaactgagaccccccaaataactctttcctcatgtgtatggtgctcct

SEQ ID NO: 286712 - DNA, 4325 bp, Homo sapiens
agctgcatttctgattatcagcctctgctaacagaagtggtcaagtgatatgtgctgttacgaaaggtacacaggaagaaattggggaaaaatgagtttgggaatcatctttatcccaaactatcttttatcatttagttggaatcagggattcctattcttttttgtagtagaaaactactttgctctttacctaaagacaatactccagctatgtgagactcggatagtgccaaaaagagtagtgagccattttcactggagtctgcaagtgtgttattcattgcaaatacttgctcttagaatggtaattactataccatctttgtgtctggaggttaaatgctaattttaaactataaaattttgtttttatactctaaatttgattgaaaacaaataggatagtaagagaagtaagaggaaaagaagattcaagaattgtcaaagtgtggaagacaagaaaatgataaaagaagaatgaaattgaatggactgattgtgtagaaaaaaaagacagccctgaagtatatttttgttgctgtgagggcaatatgtgtaatgaaaagttttcttattttccggagatggaagtcacacagcccacttcaaatccagttacacctaagccaccctattacaacatcctgctctattccttggtgccacttatgttaattgcggggattgtcatttgtgcattttgggtgtacaggcatcacaagatggcctaccctcctgtacttgttccaactcaagacccaggaccacccccaccttctccattactaggtttgaaaccactgcagttattagaagtgaaagcaaggggaagatttggttgtgtctggaaagcccagttgcttaacgaatatgtggctgtcaaaatatttccaatacaggacaaacagtcatggcaaaatgaatacgaagtctacagtttgcctggaatgaagcatgagaacatattacagttcattggtgcagaaaaacgaggcaccagtgttgatgtggatctttggctgatcacagcatttcatgaaaagggttcactatcagactttcttaaggctaatgtggtctcttggaatgaactgtgtcatattgcagaaaccatggctagaggattggcatatttacatgaggatatacctggcctaaaagatggccacaaacctgccatatctcacagggacatcaaaagtaaaaatgtgctgttgaaaaacaacctgacagcttgcattgctgactttgggttggccttaaaatttgaggctggcaagtctgcaggcgatacccatggacaggttggtacccggaggtacatggctccagaggtattagagggtgctataaacttccaaagggatgcatttttgaggatagatatgtatgccatgggattagtcctatgggaactggcttctcgctgtactgctgcagatggacctgtagatgaatacatgttgccatttgaggaggaaattggccagcatccatctcttgaagacatgcaggaagttgttgtgcataaaaaaaagaggcctgttttaagagattattggcagaaacatgctggaatggcaatgctctgtgaaaccattgaagaatgttgggatcacgacgcagaagccaggttatcagctggatgtgtaggtgaaagaattacccagatgcagagactaacaaatattattaccacagaggacattgtaacagtggtcacaatggtgacaaatgttgactttcctcccaaagaatctagtctatgatggttgcgccatctgtgcacactaagaaatgggactctgaactggagctgctaagctaaagaaactgcttacagtttattttctgtgtaaaatgagtaggatgtctcttggaaatgttaagaaagaagaccctttgttgaaaaatgttgctctgggagacttactgcattgccgacagcacagatgtgaaggacatgagactaagagaaaccttgcaaactctataaagaaacttttgaaaaagtgtacatgaagaatgtagccctctccaaatcaaggatcttttggacctggctaatggagtgtttgaaaactgacatcagatttcttaatgtctgtcagaagacactaattccttaaatgaactactgctattttttttaaatcaaaaacttttcatttcagattttaaaaagggtaacttgtttttattgcatttgctgttgtttctataaatgactattgtaatgccaatatgacacagcttgtgaatgtttagtgtgctgctgttctgtgtacataaagtcatcaaagtggggtacagtaaagaggcttccaagcattactttaacctccctcaacaaggtatacctcagttccacggttgctaaattataaaattgaaaacactaacaaaatttgaataataaatcgatccatgttttgtaacaaattcactgtgttatttaaggaaaaaaaggtaagctatgcttagtgccaacaataagtggccattcgtaaagcagtgttttagcatttcttgtgctggcttgtaatgtagggaaaaaaagtgctgttttttgaaaagatggtgtcatttcccccttcttcccatgttttaaagccccatcttatatccagttcccaaaatttgcatacttacctaagtattttttttaggtgtgctgtgtttggggaatatttgaaaatttaaagcatgatttaaaattttttaaagtgagctgtgacactggaaagctcttcattttatcttttaaaatagagttttttctatttatatatgtaaaattgtagtgtatttcttttcaccaaacagtgtgtgggacattctttatcactgttttaggatcacctcaggaagtgtcgttacccagaattccccactgtctgctatgagacttgtaactttatcactatacttctgcttggtgccatcttgtcagagtaatatttgatgtctgtgatatgtaaagaattatcctaggataaagatattaaactttaagcagatttcagatgttactgctttaaaacaaatcagggataacaaattaaacgtataacttaaaatatgcaatgacatttagaggtaaccaatgttgatataggtagcatagcctagcctcctccccaaaattgcttttacaactaacactgatactaatttaggatagttcatgccttatccttgctaagaaaatggaattgatggtaggcaggtgctaaagtgcttttcaaaacaatattacgttagaatacaattggattcttcctcaaatttatacaggccaaaaagtaaaacattaattttctgaatttccagattaccaatcaattaatcaacaaatagccagtattatgctgtgtatttctgtcaggtcattttaaaatccatgttaattttataaaagaattttttacatgtcactgtcaggagctcactgtgaatgtgttgtcttcaaatggttatttaaccacacagtacactacattttacatatatgtacgtaatctctgggaatagtaaattaattatgttatttataaacaatacataggtcaacagactttaagcagggaggaaaagaagagtaatagcgtctgtgtgctgcagaccattcagaactgtcacgtgtgtccccatggtctcattcattgtattcctagcaattcccttttcaatgttgagttcacctctttatttcacaaagtacttggtctctcaatttcttgatctggttttgcttccatttaaaaactaatcaagaagggaaaatattgagaatgtgcatacaagaaaatcattaatttcctgaagatgaatttctacctgttgtgaacatttaactttctttttaaaagttaaacaaaaataaacaagggatattatgatgaatgtttggcttatgtgagtactagagataaaatttttaaacccagttattcacaatataaaatgttttcaagttagaaaaaatttttagaaatcctgggtattgtatttaactgtagctaaccaattttaaaacttgtattcttttgagaactattattaatagaaaaactttttataagcagtaaaataagaatgttccagtgactacctgtccttatacctagtcttgttaaaactttcttttgcagggtatttagtgtttggtttacagtcagtgcagagtgggcaagttaacagaaagtttgagctagagatactggaaaaaaaaaagatcaaagaatgagaaaaatggtgatccattttggggcaaactgagaccccccaaataactctttcctcatgtgtatggtgctcct

SEQ ID NO: 286713 - DNA, 3390 bp, Homo sapiens
aacattttattagtttttttaatacagagaaaagacctcaaaaaaagttttttttttaaagctacatttcaaacagtatgcaaaggtacaattgaaaagtatgcagcatccttctcccagctgacaattggttcagtttcttgtgattacatccagaaaggggaacataaaaacttctaagtctgtaccagcataatgtctgttgatatattttttaagtatacgcagaaaggatctttctatttatacgctatagtgtgtataccttaccctggtaatagaccacatttggttttgattcatcttacaaaatcatatgttagttcataaagttaatgaatgagtactctttgcttttaacatctttttcaggttggtacccggaggtacatggctccagaggtattagagggtgctataaacttccaaagggatgcatttttgaggatagatatgtatgccatgggattagtcctatgggaactggcttctcgctgtactgctgcagatggacctgtagatgaatacatgttgccatttgaggaggaaattggccagcatccatctcttgaagacatgcaggaagttgttgtgcataaaaaaaagaggcctgttttaagagattattggcagaaacatgctggaatggcaatgctctgtgaaaccattgaagaatgttgggatcacgacgcagaagccaggttatcagctggatgtgtaggtgaaagaattacccagatgcagagactaacaaatattattaccacagaggacattgtaacagtggtcacaatggtgacaaatgttgactttcctcccaaagaatctagtctatgatggttgcgccatctgtgcacactaagaaatgggactctgaactggagctgctaagctaaagaaactgcttacagtttattttctgtgtaaaatgagtaggatgtctcttggaaatgttaagaaagaagaccctttgttgaaaaatgttgctctgggagacttactgcattgccgacagcacagatgtgaaggacatgagactaagagaaaccttgcaaactctataaagaaacttttgaaaaagtgtacatgaagaatgtagccctctccaaatcaaggatcttttggacctggctaatggagtgtttgaaaactgacatcagatttcttaatgtctgtcagaagacactaattccttaaatgaactactgctattttttttaaatcaaaaacttttcatttcagattttaaaaagggtaacttgtttttattgcatttgctgttgtttctataaatgactattgtaatgccaatatgacacagcttgtgaatgtttagtgtgctgctgttctgtgtacataaagtcatcaaagtggggtacagtaaagaggcttccaagcattactttaacctccctcaacaaggtatacctcagttccacggttgctaaattataaaattgaaaacactaacaaaatttgaataataaatcgatccatgttttgtaacaaattcactgtgttatttaaggaaaaaaaggtaagctatgcttagtgccaacaataagtggccattcgtaaagcagtgttttagcatttcttgtgctggcttgtaatgtagggaaaaaaagtgctgttttttgaaaagatggtgtcatttcccccttcttcccatgttttaaagccccatcttatatccagttcccaaaatttgcatacttacctaagtattttttttaggtgtgctgtgtttggggaatatttgaaaatttaaagcatgatttaaaattttttaaagtgagctgtgacactggaaagctcttcattttatcttttaaaatagagttttttctatttatatatgtaaaattgtagtgtatttcttttcaccaaacagtgtgtgggacattctttatcactgttttaggatcacctcaggaagtgtcgttacccagaattccccactgtctgctatgagacttgtaactttatcactatacttctgcttggtgccatcttgtcagagtaatatttgatgtctgtgatatgtaaagaattatcctaggataaagatattaaactttaagcagatttcagatgttactgctttaaaacaaatcagggataacaaattaaacgtataacttaaaatatgcaatgacatttagaggtaaccaatgttgatataggtagcatagcctagcctcctccccaaaattgcttttacaactaacactgatactaatttaggatagttcatgccttatccttgctaagaaaatggaattgatggtaggcaggtgctaaagtgcttttcaaaacaatattacgttagaatacaattggattcttcctcaaatttatacaggccaaaaagtaaaacattaattttctgaatttccagattaccaatcaattaatcaacaaatagccagtattatgctgtgtatttctgtcaggtcattttaaaatccatgttaattttataaaagaattttttacatgtcactgtcaggagctcactgtgaatgtgttgtcttcaaatggttatttaaccacacagtacactacattttacatatatgtacgtaatctctgggaatagtaaattaattatgttatttataaacaatacataggtcaacagactttaagcagggaggaaaagaagagtaatagcgtctgtgtgctgcagaccattcagaactgtcacgtgtgtccccatggtctcattcattgtattcctagcaattcccttttcaatgttgagttcacctctttatttcacaaagtacttggtctctcaatttcttgatctggttttgcttccatttaaaaactaatcaagaagggaaaatattgagaatgtgcatacaagaaaatcattaatttcctgaagatgaatttctacctgttgtgaacatttaactttctttttaaaagttaaacaaaaataaacaagggatattatgatgaatgtttggcttatgtgagtactagagataaaatttttaaacccagttattcacaatataaaatgttttcaagttagaaaaaatttttagaaatcctgggtattgtatttaactgtagctaaccaattttaaaacttgtattcttttgagaactattattaatagaaaaactttttataagcagtaaaataagaatgttccagtgactacctgtccttatacctagtcttgttaaaactttcttttgcagggtatttagtgtttggtttacagtcagtgcagagtgggcaagttaacagaaagtttgagctagagatactggaaaaaaaaaagatcaaagaatgagaaaaatggtgatccattttggggcaaactgagaccccccaaataactctttcctcatgtgtatggtgctcct

SEQ ID NO: 286714 - DNA, 3223 bp, Homo sapiens
atgggtaccttaaagggatattatataacgttaatttacaaatactgattgttccttatgtcctctgtgcagatggaaataggcatcctttatacctagataagaaagccccttatgcaatctttaagggaattacatgccaaattataggccttttcatttcccatacattagtttggtcacactgtggtataagtacagttgagagtctgtttctcttctgtcctcatagcatgtaaacagttgggaataggtgacagagtatattttagaaagtttgtaccagtttgaaagtcaggaggattttaatgaaaatgatttattttacttttcttacttttcaggacctgtagatgaatacatgttgccatttgaggaggaaattggccagcatccatctcttgaagacatgcaggaagttgttgtgcataaaaaaaagaggcctgttttaagagattattggcagaaacatgctggaatggcaatgctctgtgaaaccattgaagaatgttgggatcacgacgcagaagccaggttatcagctggatgtgtaggtgaaagaattacccagatgcagagactaacaaatattattaccacagaggacattgtaacagtggtcacaatggtgacaaatgttgactttcctcccaaagaatctagtctatgatggttgcgccatctgtgcacactaagaaatgggactctgaactggagctgctaagctaaagaaactgcttacagtttattttctgtgtaaaatgagtaggatgtctcttggaaatgttaagaaagaagaccctttgttgaaaaatgttgctctgggagacttactgcattgccgacagcacagatgtgaaggacatgagactaagagaaaccttgcaaactctataaagaaacttttgaaaaagtgtacatgaagaatgtagccctctccaaatcaaggatcttttggacctggctaatggagtgtttgaaaactgacatcagatttcttaatgtctgtcagaagacactaattccttaaatgaactactgctattttttttaaatcaaaaacttttcatttcagattttaaaaagggtaacttgtttttattgcatttgctgttgtttctataaatgactattgtaatgccaatatgacacagcttgtgaatgtttagtgtgctgctgttctgtgtacataaagtcatcaaagtggggtacagtaaagaggcttccaagcattactttaacctccctcaacaaggtatacctcagttccacggttgctaaattataaaattgaaaacactaacaaaatttgaataataaatcgatccatgttttgtaacaaattcactgtgttatttaaggaaaaaaaggtaagctatgcttagtgccaacaataagtggccattcgtaaagcagtgttttagcatttcttgtgctggcttgtaatgtagggaaaaaaagtgctgttttttgaaaagatggtgtcatttcccccttcttcccatgttttaaagccccatcttatatccagttcccaaaatttgcatacttacctaagtattttttttaggtgtgctgtgtttggggaatatttgaaaatttaaagcatgatttaaaattttttaaagtgagctgtgacactggaaagctcttcattttatcttttaaaatagagttttttctatttatatatgtaaaattgtagtgtatttcttttcaccaaacagtgtgtgggacattctttatcactgttttaggatcacctcaggaagtgtcgttacccagaattccccactgtctgctatgagacttgtaactttatcactatacttctgcttggtgccatcttgtcagagtaatatttgatgtctgtgatatgtaaagaattatcctaggataaagatattaaactttaagcagatttcagatgttactgctttaaaacaaatcagggataacaaattaaacgtataacttaaaatatgcaatgacatttagaggtaaccaatgttgatataggtagcatagcctagcctcctccccaaaattgcttttacaactaacactgatactaatttaggatagttcatgccttatccttgctaagaaaatggaattgatggtaggcaggtgctaaagtgcttttcaaaacaatattacgttagaatacaattggattcttcctcaaatttatacaggccaaaaagtaaaacattaattttctgaatttccagattaccaatcaattaatcaacaaatagccagtattatgctgtgtatttctgtcaggtcattttaaaatccatgttaattttataaaagaattttttacatgtcactgtcaggagctcactgtgaatgtgttgtcttcaaatggttatttaaccacacagtacactacattttacatatatgtacgtaatctctgggaatagtaaattaattatgttatttataaacaatacataggtcaacagactttaagcagggaggaaaagaagagtaatagcgtctgtgtgctgcagaccattcagaactgtcacgtgtgtccccatggtctcattcattgtattcctagcaattcccttttcaatgttgagttcacctctttatttcacaaagtacttggtctctcaatttcttgatctggttttgcttccatttaaaaactaatcaagaagggaaaatattgagaatgtgcatacaagaaaatcattaatttcctgaagatgaatttctacctgttgtgaacatttaactttctttttaaaagttaaacaaaaataaacaagggatattatgatgaatgtttggcttatgtgagtactagagataaaatttttaaacccagttattcacaatataaaatgttttcaagttagaaaaaatttttagaaatcctgggtattgtatttaactgtagctaaccaattttaaaacttgtattcttttgagaactattattaatagaaaaactttttataagcagtaaaataagaatgttccagtgactacctgtccttatacctagtcttgttaaaactttcttttgcagggtatttagtgtttggtttacagtcagtgcagagtgggcaagttaacagaaagtttgagctagagatactggaaaaaaaaaagatcaaagaatgagaaaaatggtgatccattttggggcaaactgagaccccccaaataactctttcctcatgtgtatggtgctcct

SEQ ID NO: 286715 - DNA, 1669 bp, Homo sapiens
ttttttttggtctgggcttccgaatatgttttatgacggttgattttacaccaggaggtttgtctccgaggaagacccagggaactggatatctagcgagaacttcctccggattccccggcgcctcgggaaaatgggagctgctgcaaagttggcgtttgccgtctttcttatctcctgttcttcaggtgctatacttggtagatcagaaactcaggagtgtcttttctttaatgctaattgggaaaaagacagaaccaatcaaactggtgttgaaccgtgttatggtgacaaagataaacggcggcattgttttgctacctggaagaatatttctggttccattgaaatagtgaaacaaggttgttggctggatgatatcaactgctatgacaggactgattgtgtagaaaaaaaagacagccctgaagtatatttttgttgctgtgagggcaatatgtgtaatgaaaagttttcttattttccggagatggaagtcacacagcccacttcaaatccagttacacctaagccaccctattacaacatcctgctctattccttggtgccacttatgttaattgcggggattgtcatttgtgcattttgggtgtacaggcatcacaagatggcctaccctcctgtacttgttccaactcaagacccaggaccacccccaccttctccattactaggtttgaaaccactgcagttattagaagtgaaagcaaggggaagatttggttgtgtctggaaagcccagttgcttaacgaatatgtggctgtcaaaatatttccaatacaggacaaacagtcatggcaaaatgaatacgaagtctacagtttgcctggaatgaagcatgagaacatattacagttcattggtgcagaaaaacgaggcaccagtgttgatgtggatctttggctgatcacagcatttcatgaaaagggttcactatcagactttcttaaggctaatgtggtctcttggaatgaactgtgtcatattgcagaaaccatggctagaggattggcatatttacatgaggatatacctggcctaaaagatggccacaaacctgccatatctcacagggacatcaaaagtaaaaatgtgctgttgaaaaacaacctgacagcttgcattgctgactttgggttggccttaaaatttgaggctggcaagtctgcaggcgatacccatggacaggttggtacccggaggtacatggctccagaggtattagagggtgctataaacttccaaagggatgcatttttgaggatagatatgtatgccatgggattagtcctatgggaactggcttctcgctgtactgctgcagatggtaagggaaaaaaatatttttaaaaaagatatatatgcctaccacacatatatgaaaagggatgatacactccaaggtaatattttaaagtacagtttttttttaattgactccaagagatggtagagaattcaggaggcaggggagcagtgggtggggtaggagaggaaaggaattgctatgtattgatcctttaccattactagctatgttgctggacacttcacataccttaaggttatttcctaaaacggtttcagaggtagttattatgctttacatatgaggaaattgagatgcagagaaattaagtagtttgc

SEQ ID NO: 286716 - DNA, 848 bp, Homo sapiens
ttttttttggtctgggcttccgaatatgttttatgacggttgattttacaccaggaggtttgtctccgaggaagacccagggaactggatatctagcgagaacttcctccggattccccggcgcctcgggaaaatgggagctgctgcaaagttggcgtttgccgtctttcttatctcctgttcttcaggtgctatacttggtagatcagaaactcaggagtgtcttttctttaatgctaattgggaaaaagacagaaccaatcaaactggtgttgaaccgtgttatggtgacaaagataaacggcggcattgttttgctacctggaagaatatttctggttccattgaaatagtgaaacaaggttgttggctggatgatatcaactgctatgacaggactgattgtgtagaaaaaaaagacagccctgaagtatatttttgttgctgtgagggcaatatgtgtaatgaaaagttttcttattttccggagatggaagtcacacagcccacttcaaatccagttacacctaagccaccctattacaacatcctgctctattccttggtgccacttatgttaattgcggggattgtcatttgtgcattttgggtgtacaggcatcacaagatggcctaccctcctgtacttgttccaactcaagacccaggaccacccccaccttctccattactaggtttgaaaccactgcagttattagaagtgaaagcaaggggaagatttggttgtgtctggaaagcccagttgcttaacgaatatgtggctgtcaaaatatttccaatacaggacaaacatatagctgtttcctggtaccgagctgactgtataa

SEQ ID NO: 286717 - DNA, 935 bp, Homo sapiens
accgaaaacgcggccgagcccggagcccggagctggagccagagcctggaccagaacttggccgccgcctgcaccgccgccgccgctgccgcccgccgccccttccccgcgccgcagccgcctcgccgccaccgccgcgagctcggccgccagtggtcctcggactttaggtgtctgggttgaaggtgctatacttggtagatcagaaactcaggagtgtcttttctttaatgctaattgggaaaaagacagaaccaatcaaactggtgttgaaccgtgttatggtgacaaagataaacggcggcattgttttgctacctggaagaatatttctggttccattgaaatagtgaaacaaggttgttggctggatgatatcaactgctatgacaggatagtaagagaagtaagaggaaaagaagattcaagaattgtcaaagtgtggaagacaagaaaatgataaaagaagaatgaaattgaatggactgattgtgtagaaaaaaaagacagccctgaagtatatttttgttgctgtgagggcaatatgtgtaatgaaaagttttcttattttccggagatggaagtcacacagcccacttcaaatccagttacacctaagccaccctattacaacatcctgctctattccttggtgccacttatgttaattgcggggattgtcatttgtgcattttgggtgtacaggcatcacaagatggcctaccctcctgtacttgttccaactcaagacccaggaccacccccaccttctccattactaggtttgaaaccactgcagttattagaagtgaaagcaaggggaagatttggttgtgtctggaaagcccagttgcttaacgaatatgtggctgtcaaaatatttccaatacaggacaaacatatagctgtttcctggtaccgagctgactgtataa

SEQ ID NO: 286718 - DNA, 551 bp, Homo sapiens
  misc_feature (16)..(16): n is a, c, g, or t
tgagatggagcttctntcttgttgcccatcctagagtgcaatggagtgagactccatctcaaaaagtaataataataaatgaattaaaaataaataaaaataaaaaagcctcaattagggctgggcacagtgggtcatgcctataatcctagcacttgggaggctgaggcaggtggatcacttgagccactgcactcaggcccccttgtgactttccttataacattttcttttctctagtttactgtattgtaagaatacagtgtataagatacaaaatatatactgaaaatatgtactgactatgttagcagtaagtaactactaatagcatactactggtcaacagcaggctattagttaagtttttagggagtcaaaagttatacacggatttttcaactgtgcagggcagggggtgttggtgcccctaacccctgagttgttcaaggatcaactgagtttgtcttctgtttgcactgcactgtcagacatttataacatccaacgatcagagacaatttgtccatcggcaaccctgacaggactaa

SEQ ID NO: 286719 - DNA, 584 bp, Homo sapiens
ctcggacgagcggcgggcacccgctgagcggacggcggccgcgtagtgaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggcctcctcctctccccacttcctcctctgagcagtcttcagccctaaatactgtggagatgatgcctaattccatctacttcggcctggactcaagaggcagggcacaggcagctcaggacaaggccccagacagctcccaaatctct

SEQ ID NO: 286720 - DNA, 894 bp, Homo sapiens
gtgcagtcaggcaggagcagagctttgacccagacccagggtgggcaggaactgaggggccaactctagcactgacttactgtgaacctggggcaagccccttcccctctctgggcctcagtttccttaacttcaaatgaagtcccttccctaagtagagagccattgctgttgttctgggatggctctgcttccagatcgcaggcctttcagcatctttctttggaggaagattggaggctggtgctcactgtccaggcctcagactctggggcagagagggggattctcagcctgagccctcccttcaccctgcccctccccccagcaatggcctgagcccccatggctgcccctcaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggcctcctcctctccccacttcctcctctgagcagtcttcagccctaaatactgtggagatgatgcctaattccatctacttcggcctggactcaagaggcagggcacaggcagctcaggacaaggccccagacagctcccaaatctct

SEQ ID NO: 286721 - DNA, 616 bp, Homo sapiens
ctcggacgagcggcgggcacccgctgagcggacggcggccgcgtagtgagcaatggcctgagcccccatggctgcccctcaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggcctcctcctctccccacttcctcctctgagcagtcttcagccctaaatactgtggagatgatgcctaattccatctacttcggcctggactcaagaggcagggcacaggcagctcaggacaaggccccagacagctcccaaatctct

SEQ ID NO: 286722 - DNA, 326 bp, Homo sapiens
tctccctgcaagaaacaagggcacagccgtgggcagagacttgggccaagaagggcacttccagccagggggatcggcttctccttaaccccacagaatgaccagggccccggcaatggagacctgtgctccttggcacgtcatccaccaaactccacagtcagggccccggcaaaggctggtcagaaggcagtgaactggggagaggacaggtaagggctgctgggcagcacccagaggagttaaacgtggactccaggaaagagggaacggatcagggagcgcccaggttgtgatggcccagggtgggtaactcaggggccgtc

SEQ ID NO: 286723 - DNA, 909 bp, Homo sapiens
gacctgcctttgcctctcctttgtcctctgccatgagtgtgaggcctccccagccatgtggaactcaaaggcttgactgaagtcacgggtctcatcattcctttcctaagctttcttcaaacagcatggtgcgtggatgaggacacacgtgctctgtagaaggtggggccacaaagccctgccgaccgacctttcctgccttctgcctctaaggtgcaaccccgaaagcacctgctggaacctttggggctcagggagcacagcctggaagcagggggatactccccagggctgcagtccacctcggaagctgctcaccacaggtgtctgcttacacttcaattcagatcacataagatacacatgcagctcttaggcttctgagccacccttcaagagcacagccactcgtggctaatggctgctgactggaaccctggatggcccaatctggaacttttcatcaccccagagcatcctgtgcagtgcttctcccggggagccctgcaggcagtgacctccagctccgagcctgatcccacatgagcaggaagaagacagcccagggaggctgcccacagccacaagctcatttctcatggcaaaccacaaatgggagatgctaagaaattagaatagaggatgctccagagcagacgctcctgtttacagagctgaaactcagtactcattaaacaactccctcctgcagccacgctgggagctgacactctccacacatgcttcatgcacccaggcgctcatccagggatcatcctgtacctcaaatacccccaagaactgtcctgccccaggacctttgcacatgctggacccactacctgtgatgccctcttctggctcaccacgtggctggctccatctcattcattggtctcagcccagtgg

SEQ ID NO: 286724 - DNA, 823 bp, Homo sapiens
tttattgttgtttgtttcttatacttttccttgctttcctcactttctgccatgggaatatgtccttgtatgtgtgctgagtaaaacaaagaggagggaatgattcacacacagtttagctcctgtcttgggtaggtggtgcctagcacttctgcctcctggccacagaagtcccagggaagaaagatgaagtgcctggtggctccaaggcagccacctcatttatcctctttggtctcaccttttcatctcaaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaaggtaaatgtgttggaaagagggctagggagctttggggtctcagagtcatgctggttgaagcagaacagcacttggcactagaggtctgagatgggagggggccagtgggggtgctgggatgtggccttcacccataggtcagatcacttagctctggtcagcccctgagagccgcagagtcctccctgtcagccagcctctgcctgtgggtcccatcattgttgctcattatctcagacctaggtgctgggccttccaccccatatgtgctactgtccctggtgaaacaggccctttgtcctgcagaggtatcactgggagatgggtagctggtgacctctacaaggtccgtg

SEQ ID NO: 286725 - DNA, 700 bp, Homo sapiens
agggaggcctcactgccagcaaccagagcaatgaggctggagcccaggcctctgttaccaggctcactattccctctggcataattcaaggcctccctatgcttatggaatctatctaaaacttgtttaataagaacatgataaatttgacctcatatcataggtggggaaacaaagacagcaccgtgtgaactagggttagaggtgctaaaactagaaagtgctccactctcctgatctttccatctccctgcaggaactctcttctcccatcccaaagaattcatctggaatatcagcccctacgtgggagtccccattcatcctacagttcatttcctctgttccctccagattaggcctcagctatcagtgattttttttatacccatttttgaacaaataacatttttttctttctcactcttttttcctagagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggtaacttaattaattaaatgttgtcttatgtaagaacctgaggagtaagagatgcaaatattttatggtgaataaaataaaagctcacttactatca

SEQ ID NO: 286726 - DNA, 491 bp, Homo sapiens
agcggggtctccgtgccgagggacccgtaggaacgggaacattgtcttcctccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggtaacttaattaattaaatgttgtcttatgtaagaacctgaggagtaagagatgcaaatattttatggtgaataaaataaaagctcacttactatca

SEQ ID NO: 286727 - DNA, 298 bp, Homo sapiens
cctggcatctgataactcactgtccatgactgaaccctggggcttccgtgccttcttccagctccttggcaagaaaggaaggtgccagcagccctgtgaatgggaaggacttggattacgtttccacctccaagacccagctggtcccatcctccaaagatggggatgtcaaagacatgctttcgcgggaccgggaaacttccagcattgagccccttccctcagactccccgaaggaggaattacgcccaattaggtaatcagctaatgttagcttctgcaccagatcaaacaaaac

SEQ ID NO: 286728 - DNA, 3118 bp, Homo sapiens
ttcagtggtgcccatcagcatgtggagccggccaccgcccctgcctccatagaagcccgctgccgcccagtccgcggtaccttgagggtcacgtcgcacagcttgccctgccgccggatctcctccatgacgccgtagccgcgactaggcaactcagacacggagaagtgcaccagatcctccagctcctccgcgccgtcctccaccatcttccccggccgctgcaactgcgcaggcctcgccggccggctagacactaaccagggcggggcgatagcgcacgccgacagccgctcggagcgcggagcagcaatcggacgggcctccgcggccgccgtagttgaatctcctcggcgccggaagccccgccactccgcttcctggttcatgtgcggccttcgttccctcgctatctcgaccttgacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctgctcatggaatttgacatctggtacaatgagtcctttgtcatccctgaggacatgcagatggcactgaagccaggcggcagcatccggccaggcatggtccctgtgaacaggattgtgtctctgggagaagatgaccaggacaaattcagccagctgcagcagagggtgcttcctgagggccctgattccatctccttctacaatgccaaagtcaagatagagcagaagcataattacttgaaaaccatgatgggcctccagcaggcacatagaaaatagaacctcatcgccagtaccttaaaggacaagaccagcaactcccacctactgtagtggagctgctcaaccacctgcccagagctgcagccccctctactccaatgctgggacccagcacagagaacacatttggcctgcatgttgggaggagcatcctccaaggacaaccttgctcatctccacagagcactttgggttttaattcactgtcttatatgcagggacaggataaaataactttctagtttggacttt

SEQ ID NO: 286729 - DNA, 2827 bp, Homo sapiens
tttgatagtaagtgagcttttattttattcaccataaaatatttgcatctcttactcctcaggttcttacataagacaacatttaattaattaagttaccattatagccatcgagggcctgagaaaccacatccttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctgctcatggaatttgacatctggtacaatgagtcctttgtcatccctgaggacatgcagatggcactgaagccaggcggcagcatccggccaggcatggtccctgtgaacaggattgtgtctctgggagaagatgaccaggacaaattcagccagctgcagcagagggtgcttcctgagggccctgattccatctccttctacaatgccaaagtcaagatagagcagaagcataattacttgaaaaccatgatgggcctccagcaggcacatagaaaatagaacctcatcgccagtaccttaaaggacaagaccagcaactcccacctactgtagtggagctgctcaaccacctgcccagagctgcagccccctctactccaatgctgggacccagcacagagaacacatttggcctgcatgttgggaggagcatcctccaaggacaaccttgctcatctccacagagcactttgggttttaattcactgtcttatatgcagggacaggataaaataactttctagtttggacttt

SEQ ID NO: 286730 - DNA, 3179 bp, Homo sapiens
ttcagtggtgcccatcagcatgtggagccggccaccgcccctgcctccatagaagcccgctgccgcccagtccgcggtaccttgagggtcacgtcgcacagcttgccctgccgccggatctcctccatgacgccgtagccgcgactaggcaactcagacacggagaagtgcaccagatcctccagctcctccgcgccgtcctccaccatcttccccggccgctgcaactgcgcaggcctcgccggccggctagacactaaccagggcggggcgatagcgcacgccgacagccgctcggagcgcggagcagcaatcggacgggcctccgcggccgccgtagttgaatctcctcggcgccggaagccccgccactccgcttcctggttcatgtgcggccttcgttccctcgctatctcgaccttgacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctgctcatggaatttgacatctggtacaatgagtcctttgtcatccctgaggacatgcagatggcactgaagccaggcggcagcatccggccaggcatggtccctgtgaacaggattgtgtctctgggagaagatgaccaggacaaattcagccagctgcagcagagggtgcttcctgagggccctgattccatctccttctacaatgccaaagtcaagatagagcagaagcataattacttgaaaaccatgatgggcctccagcaggcacatagaaaatagaacctcatcgccagtaccttaaaggacaagaccagcaactcccacctactgtagtggagctgctcaaccacctgcccagagctgcagccccctctactccaatgctgggacccagcacagagaacacatttggcctgcatgttgggaggagcatcctccaaggacaaccttgctcatctccacagagcactttgggttttaattcactgtcttatatgcagggacaggataaaataactttctagtttggactttcagtgctcatctgagaactttgtcttatttcctgtctgaaaggacatattctctatgtatg

SEQ ID NO: 286731 - DNA, 2962 bp, Homo sapiens
ttcagtggtgcccatcagcatgtggagccggccaccgcccctgcctccatagaagcccgctgccgcccagtccgcggtaccttgagggtcacgtcgcacagcttgccctgccgccggatctcctccatgacgccgtagccgcgactaggcaactcagacacggagaagtgcaccagatcctccagctcctccgcgccgtcctccaccatcttccccggccgctgcaactgcgcaggcctcgccggccggctagacactaaccagggcggggcgatagcgcacgccgacagccgctcggagcgcggagcagcaatcggacgggcctccgcggccgccgtagttgaatctcctcggcgccggaagccccgccactccgcttcctggttcatgtgcggccttcgttccctcgctatctcgaccttgacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcagctccttggcaagaaaggaaggtgccagcagccctgtgaatgggaaggacttggattacgtttccacctccaagacccagctggtcccatcctccaaagatggggatgtcaaagacatgctttcgcgggaccgggaaacttccagcattgagccccttccctcagactccccgaaggaggaattacgcccaattaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaagacaggaaacaccacaggttactgggctttccctcgctaaatcacaaccctgttccaggccagcttccatgagtgatctccagatgtcacttggtttattcctgcaagtcagatgcatcatctcactcacagggggtgcattttactcatttatttctcagaggagcagggcgtggtggcacacacttgtaatcctagcatcttgggaggctgaggcatgaaaatcgcttgagcccaggaggcagaggttgtagtgaggcaagattgcgccactgcactccagtctgggtgacagatgaagactgtcttggaaaaaaaatataataacaattaaacaattatttctcagagggc

SEQ ID NO: 286732 - DNA, 3534 bp, Homo sapiens
ttcagtggtgcccatcagcatgtggagccggccaccgcccctgcctccatagaagcccgctgccgcccagtccgcggtaccttgagggtcacgtcgcacagcttgccctgccgccggatctcctccatgacgccgtagccgcgactaggcaactcagacacggagaagtgcaccagatcctccagctcctccgcgccgtcctccaccatcttccccggccgctgcaactgcgcaggcctcgccggccggctagacactaaccagggcggggcgatagcgcacgccgacagccgctcggagcgcggagcagcaatcggacgggcctccgcggccgccgtagttgaatctcctcggcgccggaagccccgccactccgcttcctggttcatgtgcggccttcgttccctcgctatctcgaccttgacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacggtgagcaggggctgctcgccggtgggagtggggagacgggaaaagggtgtgcgcccggactgctgaaagtggctggggtccaaaaaccgctttatctgggggttcccagctgggtcgctcatctctgaaacccaggcgaaggagggctcgacgtcgcgggagtcctttcaacctgaccgcggcttacggtcttcggagctaatgttcattggtcccacaaaggggtcccacgtcgcgtccaggacatagaggccgtgaggcagggagccagaggtcgtctggactcttccgtactagtcagttttcgaactagagggggctttgggatcaccagtcggagcccttcgtgttacagctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctgctcatggaatttgacatctggtacaatgagtcctttgtcatccctgaggacatgcagatggcactgaagccaggcggcagcatccggccaggcatggtccctgtgaacaggattgtgtctctgggagaagatgaccaggacaaattcagccagctgcagcagagggtgcttcctgagggccctgattccatctccttctacaatgccaaagtcaagatagagcagaagcataattacttgaaaaccatgatgggcctccagcaggcacatagaaaatagaacctcatcgccagtaccttaaaggacaagaccagcaactcccacctactgtagtggagctgctcaaccacctgcccagagctgcagccccctctactccaatgctgggacccagcacagagaacacatttggcctgcatgttgggaggagcatcctccaaggacaaccttgctcatctccacagagcactttgggttttaattcactgtcttatatgcagggacaggataaaataactttctagtttggactttcagtgctcatctgagaactttgtcttatttcctgtctgaaaggacatattctctatgtatg

SEQ ID NO: 286733 - DNA, 3778 bp, Homo sapiens
ttcagtggtgcccatcagcatgtggagccggccaccgcccctgcctccatagaagcccgctgccgcccagtccgcggtaccttgagggtcacgtcgcacagcttgccctgccgccggatctcctccatgacgccgtagccgcgactaggcaactcagacacggagaagtgcaccagatcctccagctcctccgcgccgtcctccaccatcttccccggccgctgcaactgcgcaggcctcgccggccggctagacactaaccagggcggggcgatagcgcacgccgacagccgctcggagcgcggagcagcaatcggacgggcctccgcggccgccgtagttgaatctcctcggcgccggaagccccgccactccgcttcctggttcatgtgcggccttcgttccctcgctatctcgaccttgacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacggtgagcaggggctgctcgccggtgggagtggggagacgggaaaagggtgtgcgcccggactgctgaaagtggctggggtccaaaaaccgctttatctgggggttcccagctgggtcgctcatctctgaaacccaggcgaaggagggctcgacgtcgcgggagtcctttcaacctgaccgcggcttacggtcttcggagctaatgttcattggtcccacaaaggggtcccacgtcgcgtccaggacatagaggccgtgaggcagggagccagaggtcgtctggactcttccgtactagtcagttttcgaactagagggggctttgggatcaccagtcggagcccttcgtgttacagtagtgactgaagatagacccacatatgaagattcagctgccctctgacttccagccattaccatcaccaaccaccgccatttcctgaatacctactctgtgctgggctctgccctggacattgtgaggggattcaaaagagataaaaagcacaatccttgccttcaagcagcttgtaatttaattttggaaactgaaacccactcaaatgaagcgacgtaagaatggtaacaagcagtatttcactagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctgctcatggaatttgacatctggtacaatgagtcctttgtcatccctgaggacatgcagatggcactgaagccaggcggcagcatccggccaggcatggtccctgtgaacaggattgtgtctctgggagaagatgaccaggacaaattcagccagctgcagcagagggtgcttcctgagggccctgattccatctccttctacaatgccaaagtcaagatagagcagaagcataattacttgaaaaccatgatgggcctccagcaggcacatagaaaatagaacctcatcgccagtaccttaaaggacaagaccagcaactcccacctactgtagtggagctgctcaaccacctgcccagagctgcagccccctctactccaatgctgggacccagcacagagaacacatttggcctgcatgttgggaggagcatcctccaaggacaaccttgctcatctccacagagcactttgggttttaattcactgtcttatatgcagggacaggataaaataactttctagtttggactttcagtgctcatctgagaactttgtcttatttcctgtctgaaaggacatattctctatgtatg

SEQ ID NO: 286734 - DNA, 1041 bp, Homo sapiens
ttcagtggtgcccatcagcatgtggagccggccaccgcccctgcctccatagaagcccgctgccgcccagtccgcggtaccttgagggtcacgtcgcacagcttgccctgccgccggatctcctccatgacgccgtagccgcgactaggcaactcagacacggagaagtgcaccagatcctccagctcctccgcgccgtcctccaccatcttccccggccgctgcaactgcgcaggcctcgccggccggctagacactaaccagggcggggcgatagcgcacgccgacagccgctcggagcgcggagcagcaatcggacgggcctccgcggccgccgtagttgaatctcctcggcgccggaagccccgccactccgcttcctggttcatgtgcggccttcgttccctcgctatctcgaccttgacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggtaacttaattaattaaatgttgtcttatgtaagaacctgaggagtaagagatgcaaatattttatggtgaataaaataaaagctcacttactatca

SEQ ID NO: 286735 - DNA, 1080 bp, Homo sapiens
ttcagtggtgcccatcagcatgtggagccggccaccgcccctgcctccatagaagcccgctgccgcccagtccgcggtaccttgagggtcacgtcgcacagcttgccctgccgccggatctcctccatgacgccgtagccgcgactaggcaactcagacacggagaagtgcaccagatcctccagctcctccgcgccgtcctccaccatcttccccggccgctgcaactgcgcaggcctcgccggccggctagacactaaccagggcggggcgatagcgcacgccgacagccgctcggagcgcggagcagcaatcggacgggcctccgcggccgccgtagttgaatctcctcggcgccggaagccccgccactccgcttcctggttcatgtgcggccttcgttccctcgctatctcgaccttgacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggtaacttaattaattaaatgttgtcttatgtaagaacctgaggagtaagagatgcaaatattttatggtgaataaaataaaagctcacttactatcaaaaaaaaaagtcgacgcggccgcgaatttagtagtagta

SEQ ID NO: 286736 - DNA, 1396 bp, Homo sapiens
ttcagtggtgcccatcagcatgtggagccggccaccgcccctgcctccatagaagcccgctgccgcccagtccgcggtaccttgagggtcacgtcgcacagcttgccctgccgccggatctcctccatgacgccgtagccgcgactaggcaactcagacacggagaagtgcaccagatcctccagctcctccgcgccgtcctccaccatcttccccggccgctgcaactgcgcaggcctcgccggccggctagacactaaccagggcggggcgatagcgcacgccgacagccgctcggagcgcggagcagcaatcggacgggcctccgcggccgccgtagttgaatctcctcggcgccggaagccccgccactccgcttcctggttcatgtgcggccttcgttccctcgctatctcgaccttgacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacggtgagcaggggctgctcgccggtgggagtggggagacgggaaaagggtgtgcgcccggactgctgaaagtggctggggtccaaaaaccgctttatctgggggttcccagctgggtcgctcatctctgaaacccaggcgaaggagggctcgacgtcgcgggagtcctttcaacctgaccgcggcttacggtcttcggagctaatgttcattggtcccacaaaggggtcccacgtcgcgtccaggacatagaggccgtgaggcagggagccagaggtcgtctggactcttccgtactagtcagttttcgaactagagggggctttgggatcaccagtcggagcccttcgtgttacagctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggtaacttaattaattaaatgttgtcttatgtaagaacctgaggagtaagagatgcaaatattttatggtgaataaaataaaagctcacttactatca

SEQ ID NO: 286737 - DNA, 2962 bp, Homo sapiens
ttcagtggtgcccatcagcatgtggagccggccaccgcccctgcctccatagaagcccgctgccgcccagtccgcggtaccttgagggtcacgtcgcacagcttgccctgccgccggatctcctccatgacgccgtagccgcgactaggcaactcagacacggagaagtgcaccagatcctccagctcctccgcgccgtcctccaccatcttccccggccgctgcaactgcgcaggcctcgccggccggctagacactaaccagggcggggcgatagcgcacgccgacagccgctcggagcgcggagcagcaatcggacgggcctccgcggccgccgtagttgaatctcctcggcgccggaagccccgccactccgcttcctggttcatgtgcggccttcgttccctcgctatctcgaccttgacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcagctccttggcaagaaaggaaggtgccagcagccctgtgaatgggaaggacttggattacgtttccacctccaagacccagctggtcccatcctccaaagatggggatgtcaaagacatgctttcgcgggaccgggaaacttccagcattgagccccttccctcagactccccgaaggaggaattacgcccaattaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaaggtaaatgtgttggaaagagggctagggagctttggggtctcagagtcatgctggttgaagcagaacagcacttggcactagaggtctgagatgggagggggccagtgggggtgctgggatgtggccttcacccataggtcagatcacttagctctggtcagcccctgagagccgcagagtcctccctgtcagccagcctctgcctgtgggtcccatcattgttgctcattatctcagacctaggtgctgggccttccaccccatatgtgctactgtccctggtgaaacaggccctttgtcctgcagaggtatcactgggagatgggtagctggtgacctctacaaggtccgtg

SEQ ID NO: 286738 - DNA, 2435 bp, Homo sapiens
ttcagtggtgcccatcagcatgtggagccggccaccgcccctgcctccatagaagcccgctgccgcccagtccgcggtaccttgagggtcacgtcgcacagcttgccctgccgccggatctcctccatgacgccgtagccgcgactaggcaactcagacacggagaagtgcaccagatcctccagctcctccgcgccgtcctccaccatcttccccggccgctgcaactgcgcaggcctcgccggccggctagacactaaccagggcggggcgatagcgcacgccgacagccgctcggagcgcggagcagcaatcggacgggcctccgcggccgccgtagttgaatctcctcggcgccggaagccccgccactccgcttcctggttcatgtgcggccttcgttccctcgctatctcgaccttgacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacggtatgtaaagacagtcagtgaaaccaggctggaatcccccttcatgggtgccagggcagggtaaggctccaggctggctaccctggcacagtggccatagacattgtcaagagtggaaggatccaggggtgagtctgagccacagttgctgagggggcccagagctaggatccacacaccaagcactaagctgtgcggaggaaaagggccagccagcaggcaggctcagcatgggagactgtgtgaggagggaggctgagagccagctttgtgaagacaaggaccatgtttcctggggtgctgctcctggaattgggatcaagaaggatcgttggtgacttgttctttataatcacacatgtttaaacatcttgaaaaccccacagggttccaggctgtggttataaggccagtatgagcagatggtattaagcacctgccatgtgcaccatggtaagcaggagtaacctggtagaaattagtcttaaatgcccttgggcctcagcatcctcaacccagaaagagagagaagccatggtcctaagtaacgtgaggcccagagggaggagaccttcagaggaggccaggatgggggtgatggggaacttttcctgaagctggagtagggaaagatgggcactgagctggctggggttaaaggatgggtggtaggataagcagaggtattcctggcagaggtaatagtgggactgaagatgtgacccacaccaggaacatctatctactgcggggggtgggggctctcagc

SEQ ID NO: 286739 - DNA, 1640 bp, Homo sapiens
ttcagtggtgcccatcagcatgtggagccggccaccgcccctgcctccatagaagcccgctgccgcccagtccgcggtaccttgagggtcacgtcgcacagcttgccctgccgccggatctcctccatgacgccgtagccgcgactaggcaactcagacacggagaagtgcaccagatcctccagctcctccgcgccgtcctccaccatcttccccggccgctgcaactgcgcaggcctcgccggccggctagacactaaccagggcggggcgatagcgcacgccgacagccgctcggagcgcggagcagcaatcggacgggcctccgcggccgccgtagttgaatctcctcggcgccggaagccccgccactccgcttcctggttcatgtgcggccttcgttccctcgctatctcgaccttgacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacggtgagcaggggctgctcgccggtgggagtggggagacgggaaaagggtgtgcgcccggactgctgaaagtggctggggtccaaaaaccgctttatctgggggttcccagctgggtcgctcatctctgaaacccaggcgaaggagggctcgacgtcgcgggagtcctttcaacctgaccgcggcttacggtcttcggagctaatgttcattggtcccacaaaggggtcccacgtcgcgtccaggacatagaggccgtgaggcagggagccagaggtcgtctggactcttccgtactagtcagttttcgaactagagggggctttgggatcaccagtcggagcccttcgtgttacagtagtgactgaagatagacccacatatgaagattcagctgccctctgacttccagccattaccatcaccaaccaccgccatttcctgaatacctactctgtgctgggctctgccctggacattgtgaggggattcaaaagagataaaaagcacaatccttgccttcaagcagcttgtaatttaattttggaaactgaaacccactcaaatgaagcgacgtaagaatggtaacaagcagtatttcactagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggtaacttaattaattaaatgttgtcttatgtaagaacctgaggagtaagagatgcaaatattttatggtgaataaaataaaagctcacttactatca

SEQ ID NO: 286740 - DNA, 2858 bp, Homo sapiens
tttgatagtaagtgagcttttattttattcaccataaaatatttgcatctcttactcctcaggttcttacataagacaacatttaattaattaagttaccattatagccatcgagggcctgagaaaccacatccttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcagctccttggcaagaaaggaaggtgccagcagccctgtgaatgggaaggacttggattacgtttccacctccaagacccagctggtcccatcctccaaagatggggatgtcaaagacatgctttcgcgggaccgggaaacttccagcattgagccccttccctcagactccccgaaggaggaattacgcccaattaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctgctcatggaatttgacatctggtacaatgagtcctttgtcatccctgaggacatgcagatggcactgaagccaggcggcagcatccggccaggcatggtccctgtgaacaggattgtgtctctgggagaagatgaccaggacaaattcagccagctgcagcagagggtgcttcctgagggccctgattccatctccttctacaatgccaaagtcaagatagagcagaagcataattacttgaaaaccatgatgggcctccagcaggcacatagaaaatagaacctcatcgccagtaccttaaaggacaagaccagcaactcccacctactgtagtggagctgctcaaccacctgcccagagctgcagccccctctactccaatgctgggacccagcacagagaacacatttggcctgcatgttgggaggagcatcctccaaggacaaccttgctcatctccacagagcactttgggttttaattcactgtcttatatgcagggacaggataaaataactttctagtttggactttcagtgctcatctgagaactttgtcttatttcctgtctgaaaggacatattctctatgtatg

SEQ ID NO: 286741 - DNA, 3033 bp, Homo sapiens
agggaggcctcactgccagcaaccagagcaatgaggctggagcccaggcctctgttaccaggctcactattccctctggcataattcaaggcctccctatgcttatggaatctatctaaaacttgtttaataagaacatgataaatttgacctcatatcataggtggggaaacaaagacagcaccgtgtgaactagggttagaggtgctaaaactagaaagtgctccactctcctgatctttccatctccctgcaggaactctcttctcccatcccaaagaattcatctggaatatcagcccctacgtgggagtccccattcatcctacagttcatttcctctgttccctccagattaggcctcagctatcagtgattttttttatacccatttttgaacaaataacatttttttctttctcactcttttttcctagagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcagctccttggcaagaaaggaaggtgccagcagccctgtgaatgggaaggacttggattacgtttccacctccaagacccagctggtcccatcctccaaagatggggatgtcaaagacatgctttcgcgggaccgggaaacttccagcattgagccccttccctcagactccccgaaggaggaattacgcccaattaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctgctcatggaatttgacatctggtacaatgagtcctttgtcatccctgaggacatgcagatggcactgaagccaggcggcagcatccggccaggcatggtccctgtgaacaggattgtgtctctgggagaagatgaccaggacaaattcagccagctgcagcagagggtgcttcctgagggccctgattccatctccttctacaatgccaaagtcaagatagagcagaagcataattacttgaaaaccatgatgggcctccagcaggcacatagaaaatagaacctcatcgccagtaccttaaaggacaagaccagcaactcccacctactgtagtggagctgctcaaccacctgcccagagctgcagccccctctactccaatgctgggacccagcacagagaacacatttggcctgcatgttgggaggagcatcctccaaggacaaccttgctcatctccacagagcactttgggttttaattcactgtcttatatgcagggacaggataaaataactttctagtttggactttcagtgctcatctgagaactttgtcttatttcctgtctgaaaggacatattctctatgtatg

SEQ ID NO: 286742 - DNA, 1235 bp, Homo sapiens
tttattgttgtttgtttcttatacttttccttgctttcctcactttctgccatgggaatatgtccttgtatgtgtgctgagtaaaacaaagaggagggaatgattcacacacagtttagctcctgtcttgggtaggtggtgcctagcacttctgcctcctggccacagaagtcccagggaagaaagatgaagtgcctggtggctccaaggcagccacctcatttatcctctttggtctcaccttttcatctcaaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctgctcatggaatttgacatctggtacaatgagtcctttgtcatccctgaggacatgcagatggcactgaagccaggcggcagcatccggccaggcatggtccctgtgaacaggattgtgtctctgggagaagatgaccaggacaaattcagccagctgcagcagagggtgcttcctgagggccctgattccatctccttctacaatgccaaagtcaagatagagcagaagcataattacttgaaaaccatgatgggcctccagcaggcacatagaaaatagaacctcatcgccagtaccttaaaggacaagaccagcaactcccacctactgtagtggagctgctcaaccacctgcccagagctgcagccccctctactccaatgctgggacccagcacagagaacacatttggcctgcatgttgggaggagcatcctccaaggacaaccttgctcatctccacagagcactttgggttttaattcactgtcttatatgcagggacaggataaaataactttctagtttggactttcagtgctcatctgagaactttgtcttatttcctgtctgaaaggacatattctctatgtatg

SEQ ID NO: 286743 - DNA, 800 bp, Homo sapiens
atccccagagtatggaatgaggtgccatactggtgagggggtgcatgtggaaagtggacatttggcagagtggtcagggaccgctctacaggggacagcctgaggctggcatcagcagctgtcaaaccttggtgtgtatggtgaacatgtccaccctgagccttgggccatatacatgtgggtccccaaggggtccaagcccttaatctaactcacagacctttggctggcctctctatgtaggcggggcttgtggatgttgatggccacctagtgggtgagcctgaaggacaaaactttggactcggagtcgcccctttctctaccaaacctgggaagaaagccaagtccaagaagacattcaaagagccactcaggtgagtgaccttgccgctctgcctcctcagcagctggccctcctcggtgggtgcatgggaggatgtgcactgttcccactttccccctggtgtctcagctactgggttggcacaatggacgtcactgctgccaatactagcaagtctgtggggcccgggctgggctggtttggaaccgcacaagaatcatctctcgtcctcacagcaacctggtgaggtgggagttaatgtcttcattacactgatgaagaaacagaggcttagagaggggaagtcactcaccaaggccataccaccaatgagtagtggaatggcagcaagaagctggaccagctctccagagcccatgccctctggtactttatgttgtaccccctcccctcacttcactagggtcttcccgccgactggactcaggtcacc

SEQ ID NO: 286744 - DNA, 851 bp, Homo sapiens
gccgaggcagggctttggctactggagatcgtaggttcgaatcccgtctgggaagttcaacttgtgcacctgtaaaagaagctggcattattggcttgtactcaagggctggcacagagtgtgtcggggtgcggacgccccagccacgcccatcatccgtgcggaagatgcagaggtcatatcggatacccttctgtaccacacgatttgggcagtcatagccgcagcggcagcgggagttgcactcgtagatgggcagcccggctcgaagccgcacctggccctggtcattgtaggcaaacttgtgcagtgacgcccccgggcagcagcctccagtgggtgcccacagacagtcctggcactcgcagcccacagccacctggttgagggtgatgccctcaccaacacggtactcattgatgtacacgaaggcccgcggagggccgtccaggtccacctcattctctacagtgatgcgtcccagatggctgcgcttggcattgagctcctgctcccagcgacggagcgcccgcctctgcttggccttctgcaccaggtagttggccaagcttgggtccaggtgccggggggtctttgaccggtggtgccgccggagcagctccctttctaagtccttgtggaactgcttgaggatacgcacacacttgagattctgccgtggctcccaggtgctctctgagtctggatatccacgccatttcaccagggtcaaaggagaaaatccctttggaaacagatgtgggcagttggggacaagagggcaggacactaacttccttgtgacctgtcccctcccgaagatggttagccagatcagcggatttcttgta

SEQ ID NO: 286745 - DNA, 1271 bp, Homo sapiens
caccattattatgtgtatgtggtgttggggattgctgctgtcttacagactctgagctgcttgttttcctgggagcatctggacacatggttaatctctggagtgacatcttcccttaggtcatctgttcttgttcagcgtttttctgatttgcatccttgcctgctcctcagctaagaacttaactttctttgtttttattggaaagatccaagtaacatcctgttatgttacaggaaacttttgaaagagataaacagaattagaaaatatataaaagatgtgattgatggaggggtgatttttggaagtgtatatctttggtgagaatatactttcttatttctttttgagaggctttctggtaactacttggtgtggcagatgtcattgacatctttccagtatttccttggcttgccaatactttgtgaattaatctctctgaaatctaaacttgtatctgaggactgcagaagcacttataatacagatcttacctttgtttaggcatgcttcattctggtttgaaaaatgtccattttgtcataagagtaatactctctctaggacagcttgcatgtccaaagctggaaaatacatccggtaaacactattaactggaagcttattaatcagagttgtattctaaccagagttactttcattcattaagcttttaggaagtaagcaaatcacaagaaaaaagttggtttcaggaactttagttttagtttttaaaagcttttcctaatgtgggtcccttttgttttatgatgtattctaccatcaacgtcatggccctgtatgcatgccaggactgtttgtcttgttcaccttgaccccaggtcattgccaggcacatagcagatacacaagagatattcagtgaataaatgaaggtatgggaaaactgaaacctgggtcattgtagaattcttactcatcaagtaaaggttagttgtgatcaatctattctccttagttgagaaaacggatacacctgtgttcaaggtttttggcaaggcatacaaacgaatttcccaattattcagaaagttcagctattaatgggtcacgtagtgccctactatcactgcaaagttaccatgcctggaagcaaactctgcctcacactcgctaaaccaagtggtggtacgctgtagagtcattgccgctcagaaccccagagagagtagtattcctttatccaaataagcaccagcggttcttccttcaagcattgagcactggttctctgtcaggccgtg

SEQ ID NO: 286746 - DNA, 2096 bp, Homo sapiens
ggcacgaggccacctgcccaagaaacttgttggttgttgccctcaggtcgctcccgggcgcggacacggaacccggccatggaagatccgtcgggggctcgcgagccccgggcccggccgagagagcgggacccgggacggcgcccccacccagaccaaggccgcacccacgatcgaccgcgggaccgacccggggacccgcgcaggaagcgaagcagcgacgggaaccggcgaagggacggggaccgggacccgaagagagaccaggagagggacgggaaccgcgaccggaaccgggaccgggagagggagagagagagggaaagagacccggaccgaggcccccgccgggacacacacagggacgcgggccctcgcgcaggtgaacacggagtttgggaaaaaccgcgccaaagccggacgcgggacggagcccggggactgacctgggacgcagccgcgcctcctgggcccgcgccctgggaagccccggagccgccgcagccgcagaggaagggagaccccgggcgccgcagacccgaaagtgaacccccttcggagagatatctgccctcgacccccaggcctggacgagaggaggtggaatattaccagtcagaggcggaaggactcctggaatgccacaaatgcaaatacttgtgcactgggagagcctgctgccaaatgctggaggttctcctgaacttgctgatcctggcctgcagctctgtgtcttacagttccacagggggctacacgggcatcaccagcttggggggcatttactactatcagttcggaggggcttacagtggctttgatggtgctgacggggagaaggcccagcaactggatgtccagttctaccagctaaagctgcccatggtcactgtggcaatggcctgtagtggagccctcacagccctctgctgcctcttcgttgccatgggtgtcctgcgggtcccgtggcattgtccactgttgctggtgaccgaaggcttgttggacatgctcatcgcgggggggtacatcccggccttgtacttctacttccactacctctctgctgcctatggctctcctgtgtgtaaagagaggcaggcgctgtaccaaagcaaaggctacagcggtttcggctgcagtttccacggagcagatataggagctggaatctttgctgccctgggcattgtggtctttgccctgggggctgtcctggccataaagggctaccgaaaagttaggaagctaaaagagaagccagcagaaatgtttgaattttaagggtttctaaaacgctctgacagatgcaagtggtggtggaaggtagtctgagccactgcctttcccaagaatcccttgttgtggaagtttccaatgctggaaaagcagcgagccagcgttggtgtggtgggcggagctcccagtcgcatggagcggtgttcatggatgcaacagaccctggcttctggagtcctctgtgagtgagggaccaatcaaaattatttttcaaaaagcaaaaaaatggccggcctcggcggctcacacctgtaaccccagcactttgggaggctgaggtgggtggatcacttgaggtcaggagctcgagaccagcttggccaacatggtgagcccccgtctctactaaaatacaaaaaaattagccaggcgtggtggcgggcgcctgtaatcccagctacttgggaggctgaggcaggagaatcgcttgaatctgggaggcggagattgcagtgagccgagatcccgccactgcactccagcccaggtgacagagcgagactccatctcaaaaaaaaaaaaaagcaaaaaaactggaccccaagagccacaaggaaaaagcatgtactacaacagagtgcacctcttcattcagtaaagggaggtcaccaagagaatttgatgaaccttaccttcaaagttcctgggcacagtggctcacacctgtaatcccagagctttgggaggctgaggtaggaggattgcttgaacccaggagttcaagtttgcagtgcgctatgattgtcccactacactctagcctgagcaacagaccaagaccgtattgccaaaatacc

SEQ ID NO: 286747 - DNA, 821 bp, Homo sapiens
ggcacgaggccacctgcccaagaaacttgttggttgttgccctcaggtcgctcccgggcgcggacacggaacccggccatggaagatccgtcgggggctcgcgagccccgggcccggccgagagagcgggacccgggacggcgcccccacccagaccaaggccgcacccacgatcgaccgcgggaccgacccggggacccgcgcaggaagcgaagcagcgacgggaaccggcgaagggacggggaccgggacccgaagagagaccaggagagggacgggaaccgcgaccggaaccgggaccgggagagggagagagagagggaaagagacccggaccgaggcccccgccgggacacacacagggacgcgggccctcgcgcaggtgaacacggagtttgggaaaaaccgcgccaaagccggacgcgggacggagcccggggactgacctgggacgcagccgcgcctcctgggcccgcgccctgggaagccccggagccgccgcagccgcagaggaagggagaccccgggcgccgcagacccgaaagtgaacccccttcggagagatatctgccctcgacccccaggcctggacgagaggaggtggaatattaccagtcagaggcggaaggactcctggaatgccacaaatgcaaatacttgtgcactgggagaggtgagccgttttgcaggctgtttgatcatttactgtcactggtggttctggaagggatggtctgagctggtgaagcaaaaatttaagcagattcccttgtgggttcctagcattttcatttctgtacttgtgaggttcttgttttctt

SEQ ID NO: 286748 - DNA, 2176 bp, Homo sapiens
ctagtagaggcctcgttttaattcggacgaggtgttgccctcatgtgttgctccctgggctgcggacacggaacccggccatggaagagtcgtcgtgtggtgctcgctgatgcccctgtgtgtccctgtgctcgatgatgatgctggtgaccctgggatcgtgcgcctcccacctcatgacctaatgtgcctgctactccactgtattctgacctgctgtgtgacctgatccctggtgtgaccactgactgcagtgtgatatgctgatatgctatgcttgacggtgtgaacgctgtgcgtgaatgtgtgactgtggtgacctggtgactccgatagatgatgaccaggagagggacgggaaccgcgaccggaaccgggaccgggagagggagagagagagggaaagagacccggaccgaggcccccgccgggacacacacagggacgcgggccctcgcgcaggtgaacacggagtttgggaaaaaccgcgccaaagccggacgcgggacggagcccggggactgacctgggacgcagccgcgcctcctgggcccgcgccctgggaagccccggagccgccgcagccgcagaggaagggagaccccgggcgccgcagacccgaaagtgaacccccttcggagagatatctgccctcgacccccaggcctggacgagaggaggtggaatattaccagtcagaggcggaaggactcctggaatgccacaaatgcaaatacttgtgcactgggagagcctgctgccaaatgctggaggttctcctgaacttgctgatcctggcctgcagctctgtgtcttacagttccacagggggctacacgggcatcaccagcttggggggcatttactactatcagttcggaggggcttacagtggctttgatggtgctgacggggagaaggcccagcaactggatgtccagttctaccagctaaagctgcccatggtcactgtggcaatggcctgtagtggagccctcacagccctctgctgcctcttcgttgccatgggtgtcctgcgggtcccgtggcattgtccactgttgctggtgaccgaaggcttgttggacatgctcatcgcgggggggtacatcccggccttgtacttctacttccactacctctctgctgcctatggctctcctgtgtgtaaagagaggcaggcgctgtaccaaagcaaaggctacagcggtttcggctgcagtttccacggagcagatataggagctggaatctttgctgccctgggcattgtggtctttgccctgggggctgtcctggccataaagggctaccgaaaagttaggaagctaaaagagaagccagcagaaatgtttgaattttaagggtttctaaaacgctctgacagatgcaagtggtggtggaaggtagtctgagccactgcctttcccaagaatcccttgttgtggaagtttccaatgctggaaaagcagcgagccagcgttggtgtggtgggcggagctcccagtcgcatggagcggtgttcatggatgcaacagaccctggcttctggagtcctctgtgagtgagggaccaatcaaaattatttttcaaaaagcaaaaaaatggccggcctcggcggctcacacctgtaaccccagcactttgggaggctgaggtgggtggatcacttgaggtcaggagctcgagaccagcttggccaacatggtgagcccccgtctctactaaaatacaaaaaaattagccaggcgtggtggcgggcgcctgtaatcccagctacttgggaggctgaggcaggagaatcgcttgaatctgggaggcggagattgcagtgagccgagatcccgccactgcactccagcccaggtgacagagcgagactccatctcaaaaaaaaaaaaaagcaaaaaaactggaccccaagagccacaaggaaaaagcatgtactacaacagagtgcacctcttcattcagtaaagggaggtcaccaagagaatttgatgaaccttaccttcaaagttcctgggcacagtggctcacacctgtaatcccagagctttgggaggctgaggtaggaggattgcttgaacccaggagttcaagtttgcagtgcgctatgattgtcccactacactctagcctgagcaacagaccaagaccgtattgccaaaatacc

SEQ ID NO: 286749 - DNA, 1441 bp, Homo sapiens
ggcacgaggccacctgcccaagaaacttgttggttgttgccctcaggtcgctcccgggcgcggacacggaacccggccatggaagatccgtcgggggctcgcgagccccgggcccggccgagagagcgggacccgggacggcgcccccacccagaccaaggccgcacccacgatcgaccgcgggaccgacccggggacccgcgcaggaagcgaagcagcgacgggaaccggcgaagggacggggaccgggacccgaagagagaccaggagagggacgggaaccgcgaccggaaccgggaccgggagagggagagagagagggaaagagacccggaccgaggcccccgccgggacacacacagggacgcgggccctcgcgcaggtgaacacggagtttgggaaaaaccgcgccaaagccggacgcgggacggagcccggggactgacctgggacgcagccgcgcctcctgggcccgcgccctgggaagccccggagccgccgcagccgcagaggaagggagaccccgggcgccgcagacccgaaagtgaacccccttcggagagatatctgccctcgacccccaggcctggacgagaggaggtggaatattaccagtcagaggcggaaggactcctggaatgccacaaatgcaaatacttgtgcactgggagagcctgctgccaaatgctggaggttctcctgaacttgctgatcctggcctgcagctctgtgtcttacagttccacagggggctacacgggcatcaccagcttggggggcatttactactatcagttcggaggggcttacagtggctttgatggtgctgacggggagaaggcccagcaactggatgtccagttctaccagctaaagctgcccatggtcactgtggcaatggcctgtagtggagccctcacagccctctgctgcctcttcgttgccatgggtgtcctgcgggtcccgtggcattgtccactgttgctggtgaccgaaggcttgttggacatgctcatcgcgggggggtacatcccggccttgtacttctacttccactacctctctgctgcctatggctctcctgtgtgtaaagagaggcaggcgctgtaccaaagcaaaggctacagcggtttcggctgcagtttccacggagcagatataggagctggaatctttgctgccctgggcattgtggtctttgccctgggggctgtcctggccataaagggctaccgaaaagttaggaagctaaaagagaagccagcagaaatgtttgaattttaagggtttctaaaacgctctgacagatgcaagtggtggtggaaggtagtctgagccactgcctttcccaagaatcccttgttgtggaagtttccaatgctggaaaagcagcgagccagcgttggtggtcgacgcggccgcgaatttagtagtagtaggc

SEQ ID NO: 286750 - DNA, 1590 bp, Homo sapiens
ggggatatggcggggcctttgtctctcgctgtcgccggagtcccaggtctgtcttcactgctctgtgtcctctgctcctagaggcccagcctctgtggcgctgttaccagcagtattggagatccacagctaagatgccaggaccccctagaagcctagaaatgggactgttgacatttagggatgtggccatagaattctctctggaggagtggcaacacctggacattgcacagcagaatttatatagaaatgtgatgttagagaactacagaaacctggccttcctgggtattgctgtctctaagccagacctgatcacctgtctggaacaagggaaagagccctggaatatgaagcgacatgagatggtggatgaacccccaggtatgtgtcctcattttgctcaagacctttggccagagcagggcatggaagattcttttcaaaaagcaatactgagaagatatggaaaatatggacatgagaatttacagttaagaaaaggctgtaaaagtgtggatgagtataaggtgaacaaagaaggttataatggacttaaccagtgtttcacaactgcccagagcaaagtatttcaatgtgataaatatttgaaagtcttctataaatttttaaattcaaacagacctaagataagacatactgaaaagaaatctttcaaatgtaaaaaacgtgtcaaattattttgcatgctttcacataaaacccaacacaaaagcatttatcatagagagaagtcctacaaatgtaaagaatgtggaaaaacctttaattggtcctcaacccttactaatcataggaaaatttatactgaagagaaaccttacaaatgtgaagaatataacaaatctcctaagcaactctcaacccttactacacatgaaataattcatgctggagagaaactctacaaatgtgaagaatgtggcaaagcttttaatcggtcctcaacttttactaaacataaggtaattcatactggagtaaaaccctacaaatgtgaagaatgtggcaaagcatttttctggtcctcaaccctaactaaacataagagaattcatactggagagcaaccctacaaatgggaaaaatttggcaaagcctttaatcggtcctcgcacctcaccacagataagataactcattggagagaaatcttacaagtatgaataatgtgccaaagcctaagaaaaccctcaattcttaatagatataagattattcctactggagagaaactacaaacctgagagaggcgctaatgcttttgacagtacctaaaactttaaagaaaatcattctgctgaaaaatcctagaaatgtgaagaatgtgaaaaagcctttaaatgattgtcacacttgattgtaggtaagataattcatactggagaaaactaccagtgtgaacaacgtggccaagcttcgacaatgctcacaccctattgcacaggaaagcatttatacttgagaagaaatgtacaaatattggcaaagtaaaaaatccattaacacctgctcacatcttactcaaaattgtagagttcatagtaaataaaagcattaaaattc

SEQ ID NO: 286751 - DNA, 799 bp, Homo sapiens
catatgttattttaactaaaattaagaatgactaacttaattttaactaaaattaagaatgcttttccattcataataatgcagaggaatattattctgaacacctacctcatgcatcactcattattatgaatgaaaagcattcttaattttagttaaaattaagttagtcatatgttattttattaattgtacttctatgaaataatatgcagtctatttttaaattataaattatgtgtgaacttagcttttcaattcaacatttttaacatattaaatactattgtgaattcaatgaagtgttcttatgccactaactttaacctattcccttactcaaggatgtaggtaaaagatggtaacaatacactatttggtaagataatgtactgacatctctagcaatcttttttgccagtggctttaaattgccaataagttaaagaatattgttcctatgggttaaatttttattcttattttcacatttaaatttatttttcttaatttttgtggatacataatatgtgtatatatgtatgccatatatggtatattttgatgcaggcatactctatataataatcacattagaggaaatgagatatccattacctctagcatttattctttttattacaagcaattcaattgtacacttttagttatttttaaatttacaatgttattgattacagggtcatttttatggtcataataaaaaattttatacaaacgtgtaaaatctatacatttctgagttctgaataaatatttttaaaaattttaaaatatt

SEQ ID NO: 286752 - DNA, 442 bp, Homo sapiens
ctgaagcctgaccacagggagcattgtgacacatttcttgacccattacaatctcttctacgggcaaagctgagggactgttgacatttagggatgtggccatagaattctctctggaggagtggcaacacctggacattgcacagcagaatttatatagaaatgtgatgttagagaactacagaaacctggccttcctgggtattgctgtctctaagccagacctgatcacctgtctggaacaagggaaagagccctggaatatgaagcgacatgagatggtggatgaacccccaggattggatttttcattactgtgaagaaaaacactggaattttgataaggagttctttaaatctacaggtcactttggataatatggcagtttcataatacttattctttcaatagaaataaaacattttaaaatttaaaaaaaac

SEQ ID NO: 286753 - DNA, 498 bp, Homo sapiens
ctcatccctgaacatttctgatggtgtgattatgacatgtgactttatcttgcaacagagtgagttgattctcccgcctgagcccagcccccagaaaggattgtgacatatcgttggacccagaattgagggactgttgacatttagggatgtggccatagaattctctctggaggagtggcaacacctggacattgcacagcagaatttatatagaaatgtgatgttagagaactacagaaacctggccttcctgggtattgctgtctctaagccagacctgatcacctgtctggaacaagggaaagagccctggaatatgaagcgacatgagatggtggatgaacccccaggattggatttttcattactgtgaagaaaaacactggaattttgataaggagttctttaaatctacaggtcactttggataatatggcagtttcataatacttattctttcaatagaaataaaacattttaaaatttaaaaaaaac

SEQ ID NO: 286754 - DNA, 3068 bp, Homo sapiens
ggggatatggcggggcctttgtctctcgctgtcgccggagtcccaggtctgtcttcactgctctgtgtcctctgctcctagaggcccagcctctgtggcgctgttaccagcagtattggagatccacagctaagatgccaggaccccctagaagcctagaaatgggactgttgacatttagggatgtggccatagaattctctctggaggagtggcaacacctggacattgcacagcagaatttatatagaaatgtgatgttagagaactacagaaacctggccttcctgggtattgctgtctctaagccagacctgatcacctgtctggaacaagggaaagagccctggaatatgaagcgacatgagatggtggatgaacccccaggtatgtgtcctcattttgctcaagacctttggccagagcagggcatggaagattcttttcaaaaagcaatactgagaagatatggaaaatatggacatgagaatttacagttaagaaaaggctgtaaaagtgtggatgagtataaggtgaacaaagaaggttataatggacttaaccagtgtttcacaactgcccagagcaaagtatttcaatgtgataaatatttgaaagtcttctataaatttttaaattcaaacagacctaagataagacatactgaaaagaaatctttcaaatgtaaaaaacgtgtcaaattattttgcatgctttcacataaaacccaacacaaaagcatttatcatagagagaagtcctacaaatgtaaagaatgtggaaaaacctttaattggtcctcaacccttactaatcataggaaaatttatactgaagagaaaccttacaaatgtgaagaatataacaaatctcctaagcaactctcaacccttactacacatgaaataattcatgctggagagaaactctacaaatgtgaagaatgtggcaaagcttttaatcggtcctcaacttttactaaacataaggtaattcatactggagtaaaaccctacaaatgtgaagaatgtggcaaagcatttttctggtcctcaaccctaactaaacataagagaattcatactggagagcaaccctacaaatgggaaaaatttggcaaagcctttaatcggtcctcgcacctcaccacagataagataactcattggagagaaatcttacaagtatgaataatgtgccaaagcctaagaaaaccctcaattcttaatagatataagattattcctactggagagaaactacaaacctgagagaggcgctaatgcttttgacagtacctaaaactttaaagaaaatcattctgctgaaaaatcctagaaatgtgaagaatgtgaaaaagcctttaaatgattgtcacacttgattgtaggtaagataattcatactggagaaaactaccagtgtgaacaacgtggccaagcttcgacaatgctcacaccctattgcacaggaaagcatttatacttgagaagaaatgtacaaatattggcaaagtaaaaaatccattaacacctgctcacatcttactcaaaattgtagagttcatagtaaataaaagcattaaaattctaattactctcagaagatctgtcagaaagtatgtctttaaagtatagaagagcatttattttgaaaaaaacattacacatatgaagaggattgtaatatctttacttgtaccacagatcttattgtacacattttatactagagaaaaaccctcaggcagttgttaaaattttgttgaacatcagggagtttaagaaaaccctgcaagtataatgaatttggaaaaacattttttcaaaaactacaaattataaaacaccaaagtgttcatactaaaatatatttttgcagatacattaaatatgaaagatattcaatccaaaattaagtctatgtaaatatcagggaataattcacagtagaaatatctagggcattcaagctttagacattacactaaatcagagtgctgagtatagaaaataatacaaacagatttgtctaaacatttgtatataactttaaaaatagaatattttttggagggttataattacattcaaagtacttttttttgaaaatacagattttttttaaaagtgaataatgtgttcaactcttaaattcatgctgtttcatcattgctggtgtattcatatgtgaaagcatgtgactaattgttgctgcataaaagatatgagattcttttttattaggcattatttatgaccttttctatgaaaagataaggacattaaaatgtaagatgcgtgaggaaaatttaggtagagaggctctttgtggttaacttataatattgagtgatgcatgaggtaggtgttcagaataatattcctctgcattattatgaatgaaaagcattcttaattttagttaaaattaagttagtcatatgttattttattaattgtacttctatgaaataatatgcagtctatttttaaattataaattatgtgtgaacttagcttttcaattcaacatttttaacatattaaatactattgtgaattcaatgaagtgttcttatgccactaactttaacctattcccttactcaaggatgtaggtaaaagatggtaacaatacactatttggtaagataatgtactgacatctctagcaatcttttttgccagtggctttaaattgccaataagttaaagaatattgttcctatgggttaaatttttattcttattttcacatttaaatttatttttcttaatttttgtggatacataatatgtgtatatatgtatgccatatatggtatattttgatgcaggcatactctatataataatcacattagaggaaatgagatatccattacctctagcatttattctttttattacaagcaattcaattgtacacttttagttatttttaaatttacaatgttattgattacagggtcatttttatggtcataataaaaaattttatacaaacgtgtaaaatctatacatttctgagttctgaataaatatttttaaaaattttaaaatatt

SEQ ID NO: 286755 - DNA, 3087 bp, Homo sapiens
ctctgtgacggcctctgttgccctgtgatctgcaggtccggagagacgcacagctaagatgtcaggacatcctggaagctgggaaagggtcttgccatctctaagctggacctggtgacctttttggagggaaagaaagagccctggactgtgaagagtgaggagaccatagctgcacagccaggactgttgacatttagggatgtggccatagaattctctctggaggagtggcaacacctggacattgcacagcagaatttatatagaaatgtgatgttagagaactacagaaacctggccttcctgggtattgctgtctctaagccagacctgatcacctgtctggaacaagggaaagagccctggaatatgaagcgacatgagatggtggatgaacccccaggtatgtgtcctcattttgctcaagacctttggccagagcagggcatggaagattcttttcaaaaagcaatactgagaagatatggaaaatatggacatgagaatttacagttaagaaaaggctgtaaaagtgtggatgagtataaggtgaacaaagaaggttataatggacttaaccagtgtttcacaactgcccagagcaaagtatttcaatgtgataaatatttgaaagtcttctataaatttttaaattcaaacagacctaagataagacatactgaaaagaaatctttcaaatgtaaaaaacgtgtcaaattattttgcatgctttcacataaaacccaacacaaaagcatttatcatagagagaagtcctacaaatgtaaagaatgtggaaaaacctttaattggtcctcaacccttactaatcataggaaaatttatactgaagagaaaccttacaaatgtgaagaatataacaaatctcctaagcaactctcaacccttactacacatgaaataattcatgctggagagaaactctacaaatgtgaagaatgtggcaaagcttttaatcggtcctcaacttttactaaacataaggtaattcatactggagtaaaaccctacaaatgtgaagaatgtggcaaagcatttttctggtcctcaaccctaactaaacataagagaattcatactggagagcaaccctacaaatgggaaaaatttggcaaagcctttaatcggtcctcgcacctcaccacagataagataactcattggagagaaatcttacaagtatgaataatgtgccaaagcctaagaaaaccctcaattcttaatagatataagattattcctactggagagaaactacaaacctgagagaggcgctaatgcttttgacagtacctaaaactttaaagaaaatcattctgctgaaaaatcctagaaatgtgaagaatgtgaaaaagcctttaaatgattgtcacacttgattgtaggtaagataattcatactggagaaaactaccagtgtgaacaacgtggccaagcttcgacaatgctcacaccctattgcacaggaaagcatttatacttgagaagaaatgtacaaatattggcaaagtaaaaaatccattaacacctgctcacatcttactcaaaattgtagagttcatagtaaataaaagcattaaaattctaattactctcagaagatctgtcagaaagtatgtctttaaagtatagaagagcatttattttgaaaaaaacattacacatatgaagaggattgtaatatctttacttgtaccacagatcttattgtacacattttatactagagaaaaaccctcaggcagttgttaaaattttgttgaacatcagggagtttaagaaaaccctgcaagtataatgaatttggaaaaacattttttcaaaaactacaaattataaaacaccaaagtgttcatactaaaatatatttttgcagatacattaaatatgaaagatattcaatccaaaattaagtctatgtaaatatcagggaataattcacagtagaaatatctagggcattcaagctttagacattacactaaatcagagtgctgagtatagaaaataatacaaacagatttgtctaaacatttgtatataactttaaaaatagaatattttttggagggttataattacattcaaagtacttttttttgaaaatacagattttttttaaaagtgaataatgtgttcaactcttaaattcatgctgtttcatcattgctggtgtattcatatgtgaaagcatgtgactaattgttgctgcataaaagatatgagattcttttttattaggcattatttatgaccttttctatgaaaagataaggacattaaaatgtaagatgcgtgaggaaaatttaggtagagaggctctttgtggttaacttataatattgagtgatgcatgaggtaggtgttcagaataatattcctctgcattattatgaatgaaaagcattcttaattttagttaaaattaagttagtcatatgttattttattaattgtacttctatgaaataatatgcagtctatttttaaattataaattatgtgtgaacttagcttttcaattcaacatttttaacatattaaatactattgtgaattcaatgaagtgttcttatgccactaactttaacctattcccttactcaaggatgtaggtaaaagatggtaacaatacactatttggtaagataatgtactgacatctctagcaatcttttttgccagtggctttaaattgccaataagttaaagaatattgttcctatgggttaaatttttattcttattttcacatttaaatttatttttcttaatttttgtggatacataatatgtgtatatatgtatgccatatatggtatattttgatgcaggcatactctatataataatcacattagaggaaatgagatatccattacctctagcatttattctttttattacaagcaattcaattgtacacttttagttatttttaaatttacaatgttattgattacagggtcatttttatggtcataataaaaaattttatacaaacgtgtaaaatctatacatttctgagttctgaataaatatttttaaaaattttaaaatatt

SEQ ID NO: 286756 - DNA, 3191 bp, Homo sapiens
agcggagaggatgtaacatatccctggctgagcacccaggtgatatgacactcctgcttgtttccttccctcggggaagatgtgagataccttggctgaaatcccaggtgcagttttgacacacttctgtctagcagctgagtattgtgatcttcgaggaacgtggcccagccgtacaaataggattgtgccacactgctggacccagcacctagatgatgtaactattctcctgccttggtgctactcaaaaaagacattaacatatctcagagccttgcacccagggactgttgacatttagggatgtggccatagaattctctctggaggagtggcaacacctggacattgcacagcagaatttatatagaaatgtgatgttagagaactacagaaacctggccttcctgggtattgctgtctctaagccagacctgatcacctgtctggaacaagggaaagagccctggaatatgaagcgacatgagatggtggatgaacccccaggtatgtgtcctcattttgctcaagacctttggccagagcagggcatggaagattcttttcaaaaagcaatactgagaagatatggaaaatatggacatgagaatttacagttaagaaaaggctgtaaaagtgtggatgagtataaggtgaacaaagaaggttataatggacttaaccagtgtttcacaactgcccagagcaaagtatttcaatgtgataaatatttgaaagtcttctataaatttttaaattcaaacagacctaagataagacatactgaaaagaaatctttcaaatgtaaaaaacgtgtcaaattattttgcatgctttcacataaaacccaacacaaaagcatttatcatagagagaagtcctacaaatgtaaagaatgtggaaaaacctttaattggtcctcaacccttactaatcataggaaaatttatactgaagagaaaccttacaaatgtgaagaatataacaaatctcctaagcaactctcaacccttactacacatgaaataattcatgctggagagaaactctacaaatgtgaagaatgtggcaaagcttttaatcggtcctcaacttttactaaacataaggtaattcatactggagtaaaaccctacaaatgtgaagaatgtggcaaagcatttttctggtcctcaaccctaactaaacataagagaattcatactggagagcaaccctacaaatgggaaaaatttggcaaagcctttaatcggtcctcgcacctcaccacagataagataactcattggagagaaatcttacaagtatgaataatgtgccaaagcctaagaaaaccctcaattcttaatagatataagattattcctactggagagaaactacaaacctgagagaggcgctaatgcttttgacagtacctaaaactttaaagaaaatcattctgctgaaaaatcctagaaatgtgaagaatgtgaaaaagcctttaaatgattgtcacacttgattgtaggtaagataattcatactggagaaaactaccagtgtgaacaacgtggccaagcttcgacaatgctcacaccctattgcacaggaaagcatttatacttgagaagaaatgtacaaatattggcaaagtaaaaaatccattaacacctgctcacatcttactcaaaattgtagagttcatagtaaataaaagcattaaaattctaattactctcagaagatctgtcagaaagtatgtctttaaagtatagaagagcatttattttgaaaaaaacattacacatatgaagaggattgtaatatctttacttgtaccacagatcttattgtacacattttatactagagaaaaaccctcaggcagttgttaaaattttgttgaacatcagggagtttaagaaaaccctgcaagtataatgaatttggaaaaacattttttcaaaaactacaaattataaaacaccaaagtgttcatactaaaatatatttttgcagatacattaaatatgaaagatattcaatccaaaattaagtctatgtaaatatcagggaataattcacagtagaaatatctagggcattcaagctttagacattacactaaatcagagtgctgagtatagaaaataatacaaacagatttgtctaaacatttgtatataactttaaaaatagaatattttttggagggttataattacattcaaagtacttttttttgaaaatacagattttttttaaaagtgaataatgtgttcaactcttaaattcatgctgtttcatcattgctggtgtattcatatgtgaaagcatgtgactaattgttgctgcataaaagatatgagattcttttttattaggcattatttatgaccttttctatgaaaagataaggacattaaaatgtaagatgcgtgaggaaaatttaggtagagaggctctttgtggttaacttataatattgagtgatgcatgaggtaggtgttcagaataatattcctctgcattattatgaatgaaaagcattcttaattttagttaaaattaagttagtcatatgttattttattaattgtacttctatgaaataatatgcagtctatttttaaattataaattatgtgtgaacttagcttttcaattcaacatttttaacatattaaatactattgtgaattcaatgaagtgttcttatgccactaactttaacctattcccttactcaaggatgtaggtaaaagatggtaacaatacactatttggtaagataatgtactgacatctctagcaatcttttttgccagtggctttaaattgccaataagttaaagaatattgttcctatgggttaaatttttattcttattttcacatttaaatttatttttcttaatttttgtggatacataatatgtgtatatatgtatgccatatatggtatattttgatgcaggcatactctatataataatcacattagaggaaatgagatatccattacctctagcatttattctttttattacaagcaattcaattgtacacttttagttatttttaaatttacaatgttattgattacagggtcatttttatggtcataataaaaaattttatacaaacgtgtaaaatctatacatttctgagttctgaataaatatttttaaaaattttaaaatatt

SEQ ID NO: 286757 - DNA, 2555 bp, Homo sapiens
  misc_feature (21)..(21): n is a, c, g, or t
agttcgacggagactctctantgatatgctttcacataaaacccaacacaaaagcatttatcatagagagaagtcctacaaatgtaaagaatgtggaaaaacctttaattggtcctcaacccttactaatcataggaaaatttatactgaagagaaaccttacaaatgtgaagaatataacaaatctcccttttagccaatcctcaacccttactacacataagataattcatactggagagaaaccctacaaatgtgaagaatgtggcaaagcctttaactggtcctcaactcttactaaacataagataattcatactgaagagaaaccctacaaatgtgaaaaatgtggcaaagcctttaagcagtcttcaatccttactaaccataagagaattcatactggagagaaaccctataaatgtgaagaatgtggcaaagcttttaatcggtcctcaacttttactaaacataaggtaattcatactggagtaaaaccctacaaatgtgaagaatgtggcaaagcatttttctggtcctcaaccctaactaaacataagagaattcatactggagagcaaccctacaaatgggaaaaatttggcaaagcctttaatcggtcctcgcacctcaccacagataagataactcattggagagaaatcttacaagtatgaataatgtgccaaagcctaagaaaaccctcaattcttaatagatataagattattcctactggagagaaactacaaacctgagagaggcgctaatgcttttgacagtacctaaaactttaaagaaaatcattctgctgaaaaatcctagaaatgtgaagaatgtgaaaaagcctttaaatgattgtcacacttgattgtaggtaagataattcatactggagaaaactaccagtgtgaacaacgtggccaagcttcgacaatgctcacaccctattgcacaggaaagcatttatacttgagaagaaatgtacaaatattggcaaagtaaaaaatccattaacacctgctcacatcttactcaaaattgtagagttcatagtaaataaaagcattaaaattctaattactctcagaagatctgtcagaaagtatgtctttaaagtatagaagagcatttattttgaaaaaaacattacacatatgaagaggattgtaatatctttacttgtaccacagatcttattgtacacattttatactagagaaaaaccctcaggcagttgttaaaattttgttgaacatcagggagtttaagaaaaccctgcaagtataatgaatttggaaaaacattttttcaaaaactacaaattataaaacaccaaagtgttcatactaaaatatatttttgcagatacattaaatatgaaagatattcaatccaaaattaagtctatgtaaatatcagggaataattcacagtagaaatatctagggcattcaagctttagacattacactaaatcagagtgctgagtatagaaaataatacaaacagatttgtctaaacatttgtatataactttaaaaatagaatattttttggagggttataattacattcaaagtacttttttttgaaaatacagattttttttaaaagtgaataatgtgttcaactcttaaattcatgctgtttcatcattgctggtgtattcatatgtgaaagcatgtgactaattgttgctgcataaaagatatgagattcttttttattaggcattatttatgaccttttctatgaaaagataaggacattaaaatgtaagatgcgtgaggaaaatttaggtagagaggctctttgtggttaacttataatattgagtgatgcatgaggtaggtgttcagaataatattcctctgcattattatgaatgaaaagcattcttaattttagttaaaattaagttagtcatatgttattttattaattgtacttctatgaaataatatgcagtctatttttaaattataaattatgtgtgaacttagcttttcaattcaacatttttaacatattaaatactattgtgaattcaatgaagtgttcttatgccactaactttaacctattcccttactcaaggatgtaggtaaaagatggtaacaatacactatttggtaagataatgtactgacatctctagcaatcttttttgccagtggctttaaattgccaataagttaaagaatattgttcctatgggttaaatttttattcttattttcacatttaaatttatttttcttaatttttgtggatacataatatgtgtatatatgtatgccatatatggtatattttgatgcaggcatactctatataataatcacattagaggaaatgagatatccattacctctagcatttattctttttattacaagcaattcaattgtacacttttagttatttttaaatttacaatgttattgattacagggtcatttttatggtcataataaaaaattttatacaaacgtgtaaaatctatacatttctgagttctgaataaatatttttaaaaattttaaaatatt

SEQ ID NO: 286758 - DNA, 2941 bp, Homo sapiens
ggggatatggcggggcctttgtctctcgctgtcgccggagtcccaggtctgtcttcactgctctgtgtcctctgctcctagaggcccagcctctgtggcgctgttaccagcagtattggagatccacagctaagatgccaggaccccctagaagcctagaaatggtattgctgtctctaagccagacctgatcacctgtctggaacaagggaaagagccctggaatatgaagcgacatgagatggtggatgaacccccaggtatgtgtcctcattttgctcaagacctttggccagagcagggcatggaagattcttttcaaaaagcaatactgagaagatatggaaaatatggacatgagaatttacagttaagaaaaggctgtaaaagtgtggatgagtataaggtgaacaaagaaggttataatggacttaaccagtgtttcacaactgcccagagcaaagtatttcaatgtgataaatatttgaaagtcttctataaatttttaaattcaaacagacctaagataagacatactgaaaagaaatctttcaaatgtaaaaaacgtgtcaaattattttgcatgctttcacataaaacccaacacaaaagcatttatcatagagagaagtcctacaaatgtaaagaatgtggaaaaacctttaattggtcctcaacccttactaatcataggaaaatttatactgaagagaaaccttacaaatgtgaagaatataacaaatctcctaagcaactctcaacccttactacacatgaaataattcatgctggagagaaactctacaaatgtgaagaatgtggcaaagcttttaatcggtcctcaacttttactaaacataaggtaattcatactggagtaaaaccctacaaatgtgaagaatgtggcaaagcatttttctggtcctcaaccctaactaaacataagagaattcatactggagagcaaccctacaaatgggaaaaatttggcaaagcctttaatcggtcctcgcacctcaccacagataagataactcattggagagaaatcttacaagtatgaataatgtgccaaagcctaagaaaaccctcaattcttaatagatataagattattcctactggagagaaactacaaacctgagagaggcgctaatgcttttgacagtacctaaaactttaaagaaaatcattctgctgaaaaatcctagaaatgtgaagaatgtgaaaaagcctttaaatgattgtcacacttgattgtaggtaagataattcatactggagaaaactaccagtgtgaacaacgtggccaagcttcgacaatgctcacaccctattgcacaggaaagcatttatacttgagaagaaatgtacaaatattggcaaagtaaaaaatccattaacacctgctcacatcttactcaaaattgtagagttcatagtaaataaaagcattaaaattctaattactctcagaagatctgtcagaaagtatgtctttaaagtatagaagagcatttattttgaaaaaaacattacacatatgaagaggattgtaatatctttacttgtaccacagatcttattgtacacattttatactagagaaaaaccctcaggcagttgttaaaattttgttgaacatcagggagtttaagaaaaccctgcaagtataatgaatttggaaaaacattttttcaaaaactacaaattataaaacaccaaagtgttcatactaaaatatatttttgcagatacattaaatatgaaagatattcaatccaaaattaagtctatgtaaatatcagggaataattcacagtagaaatatctagggcattcaagctttagacattacactaaatcagagtgctgagtatagaaaataatacaaacagatttgtctaaacatttgtatataactttaaaaatagaatattttttggagggttataattacattcaaagtacttttttttgaaaatacagattttttttaaaagtgaataatgtgttcaactcttaaattcatgctgtttcatcattgctggtgtattcatatgtgaaagcatgtgactaattgttgctgcataaaagatatgagattcttttttattaggcattatttatgaccttttctatgaaaagataaggacattaaaatgtaagatgcgtgaggaaaatttaggtagagaggctctttgtggttaacttataatattgagtgatgcatgaggtaggtgttcagaataatattcctctgcattattatgaatgaaaagcattcttaattttagttaaaattaagttagtcatatgttattttattaattgtacttctatgaaataatatgcagtctatttttaaattataaattatgtgtgaacttagcttttcaattcaacatttttaacatattaaatactattgtgaattcaatgaagtgttcttatgccactaactttaacctattcccttactcaaggatgtaggtaaaagatggtaacaatacactatttggtaagataatgtactgacatctctagcaatcttttttgccagtggctttaaattgccaataagttaaagaatattgttcctatgggttaaatttttattcttattttcacatttaaatttatttttcttaatttttgtggatacataatatgtgtatatatgtatgccatatatggtatattttgatgcaggcatactctatataataatcacattagaggaaatgagatatccattacctctagcatttattctttttattacaagcaattcaattgtacacttttagttatttttaaatttacaatgttattgattacagggtcatttttatggtcataataaaaaattttatacaaacgtgtaaaatctatacatttctgagttctgaataaatatttttaaaaattttaaaatatt

SEQ ID NO: 286759 - DNA, 1096 bp, Homo sapiens
ggggatatggcggggcctttgtctctcgctgtcgccggagtcccaggtctgtcttcactgctctgtgtcctctgctcctagaggcccagcctctgtggcgctgttaccagcagtattggagatccacagctaagatgccaggaccccctagaagcctagaaatgggactgttgacatttagggatgtggccatagaattctctctggaggagtggcaacacctggacattgcacagcagaatttatatagaaatgtgatgttagagaactacagaaacctggccttcctgggtattgctgtctctaagccagacctgatcacctgtctggaacaagggaaagagccctggaatatgaagcgacatgagatggtggatgaacccccaggtatgtgtcctcattttgctcaagacctttggccagagcagggcatggaagattcttttcaaaaagcaatactgagaagatatggaaaatatggacatgagaatttacagttaagaaaaggctgtaaaagtgtggatgagtataaggtgaacaaagaaggttataatggacttaaccagtgtttcacaactgcccagagcaaagtatttcaatgtgataaatatttgaaagtcttctataaatttttaaattcaaacagacctaagataagacatactgaaaagaaatctttcaaatgtaaaaaacgtgtcaaattattttgcatgctttcacataaaacccaacacaaaagcatttatcatagagagaagtcctacaaatgtaaagaatgtggaaaaacctttaattggtcctcaacccttactaatcataggaaataagcaactctcaacccttactacacatgaaataattcatgctggagagaaactctacaaatgtgaagaatgtggtgaagcttttaatcgatcctcaaatcttactacacataagataattcatactggagagaaaccttacaagtgtgaagaatgtggcaaagcatttatctggtcctcaacccttactgagcataagaaaattcatactagaaagaaaccctacaagtgtgaagaatgtggcaaagcatttatatggtcctcaacactaa

SEQ ID NO: 286760 - DNA, 466 bp, Homo sapiens
actctaaaggatcccccagagtccaaacagtgccagaaatgatcaatgatgaagtgggggttgggcagctagctggctggagaggtgagccaaaggaacccaggagtggacacctgagggagtggggtctcagaggaactgggcagagctaaatgggctaagtcttaagaggcaggggcaggaaatgtaatggaggctttctactctacaacgtccaatcctgctggggagggcatggagtatttcagagtaggaaagaatgagggagaggatagtcagataaatcaaagtttcattcttttcctcctctttcttagctcgtcaaatcctacactttctctccagctggaattatggtggtgagtgagggagttaaaataatcctggctcctccctaatcaatggcagtagagagccgaaagttggaagaagcacgtaaaacaggtatgtagcttcaagaagacac

SEQ ID NO: 286761 - DNA, 790 bp, Homo sapiens
ggaggctgaggcacagtgagggtcaggggcttgccctgatctttgcagagaggtacctggattctccatccttgtcgtgtctctggtcttctcttggctgggtttcctgttctgcttcatctgaagccaggagctgtgatctctgcagaggcttccttgatttgctgagctctctcctgacttcttcagcaccatctcctcccaggtctgatgggattttgccttctgagaaacaagagagatgtgagagccccagggctaaacccttccaagtatctgggcaccatgatctagcagacaagttggtgagggttaaggagtggggtgtgaggaggtgtgttctacctctgggaggaatcgcggcctgggaatgcggccctcggtccactgaagcgtgcccaggtcgccctcgacctctcgtacaatcgcctcatactcagctcgcaggctctggaactggcgtcggaccaagaagccccggacgcaggcctggtatggagaacgagaggaaagaagtcccttatcacggaaaaatcctgtgaaccccgcgcccgcccccgcacctgcaatgcagacaccttccgaaccagcagctctggctccatgggcgccaactgccaggcccgcccgcgcgcctgcgaagtacgtcattggtcggcgtcgctcctgagcatgcgcgggcgtgggctttgccccagccgttcccacggcaacctcctaccgtccagggtagaggcgtcctggcgacaggcgtacctgcgtccccccagcccccgactgcccctcccac

SEQ ID NO: 286762 - DNA, 662 bp, Homo sapiens
ggaggctgaggcacagtgagggtcaggggcttgccctgatctttgcagagaggtacctggattctccatccttgtcgtgtctctggtcttctcttggctgggtttcctgttctgcttcatctgaagccaggagctgtgatctctgcagaggcttccttgatttgctgagctctctcctgacttcttcagcaccatctcctcccaggtctgatgggattttgccttctgagaaacaagagagatgtgagagccccagggctaaacccttccaagtatctgggcaccatgatctagcagacaagttggtgagggttaaggagtggggtgtgaggaggtgagtctactgcctcttccagtgagaaaagcttatcactgggaagggtgggttccaccctgcccaagtccctccttcccttctctcctaggtgtgttctacctctgggaggaatcgcggcctgggaatgcggccctcggtccactgaagcgtgcccaggtcgccctcgacctctcgtacaatcgcctcatactcagctcgcaggctctggaactggcgtcggaccaagaagccccggacgcaggcctggtatggagaacgagaggaaagaagtcccttatcacggtaagagagggggcatctcggaggactgtcctgaagaggtcgt

SEQ ID NO: 286763 - DNA, 1456 bp, Homo sapiens
gtgagcttgctccttaagttacaggaactctccttataatagacacttcattttcctagtccatccctcatgaaaaatgactgaccactgctgggcagcaggagggtcataatccctaactccaatcactggcaactcctgagatcagaggaaaaccagcaacagcgtgggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtgagaacagtcagcaaaagcattggtcccacctgcccctttgctggaagctgtgaagtcagcagccagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaaaatgctgggaccaaagattgggccgggttcaaagggagcccagtggttgcaatgaaagactaaagcaaaac

SEQ ID NO: 286764 - DNA, 1324 bp, Homo sapiens
aaacagacatctcttgttttccagatactacgggtcataatccctaactccaatcactggcaactcctgagatcagaggaaaaccagcaacagcgtgggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagccagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaaaatgctgggaccaaagattgggccgggttcaaagggagcccagtggttgcaatgaaagactaaagcaaaac

SEQ ID NO: 286765 - DNA, 1207 bp, Homo sapiens
aaacagacatctcttgttttccagatactacgggtcataatccctaactccaatcactggcaactcctgagatcagaggaaaaccagcaacagcgtgggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagccagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaaaatgctgggaccaaagattgggccgggttcaaagggagcccagtggttgcaatgaaagactaaagcaaaac

SEQ ID NO: 286766 - DNA, 1613 bp, Homo sapiens
aaacagacatctcttgttttccagatactacgggtcataatccctaactccaatcactggcaactcctgagatcagaggaaaaccagcaacagcgtgggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagccagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtggtgagatggtgctagagcaatagggggcatgtgtcctcatggtacaggatgtggtcaggtgacctagaggctcctaatcctagtatctcccacagtggggttccaggtagagtttttggagttgctctttcacttccatggaacactacgaaaactgcagctccaagagcctgagtatgtgctcttggctgccatggccctcttctctcctgcctggtgagcacctcccaaagcccagagccttttgctgcaccacctctgcccaaatactcagctccttgagtccatccacccaggccttctagcctagctatcaaacctgcagactaggtctatcccagcctcagtccccggggcaccacgcaggcccacccctgccacccaacttgtccttcccagctccctaaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaaaatgctgggaccaaagattgggccgggttcaaagggagcccagtggttgcaatgaaagactaaagcaaaac

SEQ ID NO: 286767 - DNA, 1551 bp, Homo sapiens
aaacagacatctcttgttttccagatactacgggtcataatccctaactccaatcactggcaactcctgagatcagaggaaaaccagcaacagcgtgggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagccagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtggtgagatggtgctagagcaatagggggcatgtgtcctcatggtacaggatgtggtcaggtgacctagaggctcctaatcctagtatctcccacagtggggttccaggtagagtttttggagttgctctttcacttccatggaacactacgcctggtgagcacctcccaaagcccagagccttttgctgcaccacctctgcccaaatactcagctccttgagtccatccacccaggccttctagcctagctatcaaacctgcagactaggtctatcccagcctcagtccccggggcaccacgcaggcccacccctgccacccaacttgtccttcccagctccctaaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaaaatgctgggaccaaagattgggccgggttcaaagggagcccagtggttgcaatgaaagactaaagcaaaac

SEQ ID NO: 286768 - DNA, 813 bp, Homo sapiens
gtgagcttgctccttaagttacaggaactctccttataatagacacttcattttcctagtccatccctcatgaaaaatgactgaccactgctgggcagcaggagggtcataatccctaactccaatcactggcaactcctgagatcagaggaaaaccagcaacagcgtgggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtgagtctcctccccaatggaaatagccctccaaaccaaactccctattagtcagcctttacaccctcgctggtgcccaagcctgtccagctacattactcctttatcttagagtctaactaccctgtggctggcatcctacatcttgccaaacacatcactgtataaactggtggcataacagagggaaagctgaatgtttgtctgatggacacagcccattagtcaagagcatttattatgtacccactgcctgtgaagcacctagctagtactacatcaactaggctttctggagtgatcctgtgttgccatggaaatgcttgagatgtgttggatactatccacccctggggacctttgggcacagctcagattagtccatttcaccagattcccaggtcttttagaccatgtcatctcagcc

SEQ ID NO: 286769 - DNA, 255 bp, Homo sapiens
ggagggccctagggccagagcctctagctaatgttctgatcattgcagcctccagctcatctgttcatccatcaccagcccttgcccaccctggcccctgtgctgcctctggtcacacacttcgcagacatcaacactttcatggtactgcaagtcatcaagtttactaaggacctgcccgtcttccggtgagtgacctcccctcatctttcaggaggcaaacacttcagtaaattgtatatccaccccgaaaag

SEQ ID NO: 286770 - DNA, 878 bp, Homo sapiens
gagggcaggcgtgagcaaccatggccgggcagcacctcccggtaccccggctggagggcgtttctcgggagcagttcatgcagcacctctacccacagagaaaacctcttgtgttggaagggattgatttggggccatgtacaagcaaatggacagtggattacctaagccaagttggagggaagaaagaagtaaagattcatgttgctgcagttgcacagatggacttcattaaactttaccttttgaccagttggtccagagggcagctgaagagaaacataaagaattctttgtttcagaggatgagaaatactacttacggtcacttggagaagaccctagaaaggatgttgcagatatcagaaagcagtttcctttgttgaaaggagatattaagtttccagaattcttcaaagaggaacagttcttttccagtgtttttcgaattagttcaccaggattacaactatggactcattatgatgtatgctacataaatgagaaatttaaagctacaatagatctttagcattatagatttaacagtcacagtttcaacttcctataggttaccctaaacatctgtgtaatttgctgaaacatgacttttgaaaataggtgctgtgcatagcagtgatacaggaatgaattattttgctaatggcaaagcctagttggttcctcacatttgtatttccctgtggtcctattcttgattcatcatcatatatataccaagttttgtgaagtgatttttttttccatgtgaaaaatggccaccagataatgggggaaattgtattggaaaaagtgataagcctttagtataaggaggtataaatgatacacatgactctggctacccagagatccat

SEQ ID NO: 286771 - DNA, 2134 bp, Homo sapiens
gagggcaggcgtgagcaaccatggccgggcagcacctcccggtaccccggctggagggcgtttctcgggagcagttcatgcagcacctctacccacagagaaaacctcttgtgttggaagggattgatttggggccatgtacaagcaaatggacagtggattacctaagccaagttggagggaagaaagaagtaaagattcatgttgctgcagttgcacagatggacttcattaaactttaccttttgaccagttggtccagagggcagctgaagagaaacataaagaattctttgtttcagaggatgagaaatactacttacggtcacttggagaagaccctagaaaggatgttgcagatatcagaaagcagtttcctttgttgaaaggagatattaagtttccagaattcttcaaagaggaacagttcttttccagtgtttttcgaattagttcaccaggattacaactatggactcattatgatgtaatggataatttgttaatacaagtgacaggaaaaaagcgtgttgtactcttcagtcctcgagatgcccagtatttatatttaaaaggtactaaatcagaagtactgaatatagataacccagacttggctaaatatccacttttttccaaggctagaagatatgaatgttcccttgaagctggtgatgtattattcattcctgctttatggttccataatgtaatttctgaagagtttggagtgggagtgaatatcttttggaagcaccttccatctgaatgctatgataaaacagatacctatggaaacaaagatcctacagcagcatcaagagctgcacaaattctggacagagccttgaaaacactggccgagttaccagaggaatatagggacttctatgcacgacgaatggtcctacacattcaagacaaagcctacagcaagaactctgagtaaataatgaagtgaatgcaatgcacattaacactttagtaaggtataacgatataaattaaagattttgttaaaataggaaagatacatcagatttacagattatgtaagtacgaaggggtgtttgtgtggattctacttgatacagattgttataattaaagaatgctgtgctgggaccactctttaacattcagatgctgaccactaaaagtccaacttaaaatgacttaaaaacagtaagaaaatatattgattcacaatacatgaaatctattgacagaatgtgctgcagtgtttctgatccaatgattcagtaatgtcatcaagaaccttgggaacccgcctccacaccccacccccttttcaaccacaacattggcatcatcctaaggctggctaccctcgtggtcatgggatgattgccagtagcagttggagccttgtgcatcttcatttacatgcagcggaagagtcaggctggattctaggggccctgtcctagtatgagaaagctttcccagaattcactttccatatccttaggtctcattgctctaaagtaacttagacctgtccatccctgagccagtcactggcaaagggtctagaataacctttagggcagtcaggtccactggagctgagagtagaagtggaggccacatgagggatatatggggacagaaaggatagtttttttaaaatcatggttctgataggaaaaacatgagcaacgcacaatatctattacatttgcctagaagcagaattttttgaggaactttaaaaaatgtacagatacctaggtcccaactttgtagactgattcaagagtgtttgggatttggtataggaacttaatagacctcacagggtgttctgatgcataatcagagctgagatcaactggagttgatgatagtgacttggattattagttttgtgattagtgcaaaacaaatgtttaatctgatcttgacttttcttgccacccagtatgtcagggtggtttttggtttttgaatgttacaaaataaatattttaatttatacctatgtctaaaccttagcctagttaaagatttcccaactattttttccacctatcccttttttaaaagaaaaattacttaaagaatgaataaatgagatcctaaaagtgttgtcatcgaagacagtgagcca

SEQ ID NO: 286772 - DNA, 1818 bp, Homo sapiens
gatcgagtcggtacccctagttttagaagtttcgatgttgcagatatcagaaagcagtttcctttgttgaaaggagatattaagtttccagaattcttcaaagaggaacagttcttttccagtgtttttcgaattagttcaccaggattacaactatggactcattatgatgtaatggataatttgttaatacaagtgacaggaaaaaagcgtgttgtactcttcagtcctcgagatgcccagtatttatatttaaaaggtactaaatcagaagtactgaatatagataacccagacttggctaaatatccacttttttccaaggctagaagatatgaatgttcccttgaagctggtgatgtattattcattcctgctttatggttccataatgtaatttctgaagagtttggagtgggagtgaatatcttttggaagcaccttccatctgaatgctatgataaaacagatacctatggaaacaaagatcctacagcagcatcaagagctgcacaaattctggacagagccttgaaaacactggccgagttaccagaggaatatagggacttctatgcacgacgaatggtcctacacattcaagacaaagcctacagcaagaactctgagtaaataatgaagtgaatgcaatgcacattaacactttagtaaggtataacgatataaattaaagattttgttaaaataggaaagatacatcagatttacagattatgtaagtacgaaggggtgtttgtgtggattctacttgatacagattgttataattaaagaatgctgtgctgggaccactctttaacattcagatgctgaccactaaaagtccaacttaaaatgacttaaaaacagtaagaaaatatattgattcacaatacatgaaatctattgacagaatgtgctgcagtgtttctgatccaatgattcagtaatgtcatcaagaaccttgggaacccgcctccacaccccacccccttttcaaccacaacattggcatcatcctaaggctggctaccctcgtggtcatgggatgattgccagtagcagttggagccttgtgcatcttcatttacatgcagcggaagagtcaggctggattctaggggccctgtcctagtatgagaaagctttcccagaattcactttccatatccttaggtctcattgctctaaagtaacttagacctgtccatccctgagccagtcactggcaaagggtctagaataacctttagggcagtcaggtccactggagctgagagtagaagtggaggccacatgagggatatatggggacagaaaggatagtttttttaaaatcatggttctgataggaaaaacatgagcaacgcacaatatctattacatttgcctagaagcagaattttttgaggaactttaaaaaatgtacagatacctaggtcccaactttgtagactgattcaagagtgtttgggatttggtataggaacttaatagacctcacagggtgttctgatgcataatcagagctgagatcaactggagttgatgatagtgacttggattattagttttgtgattagtgcaaaacaaatgtttaatctgatcttgacttttcttgccacccagtatgtcagggtggtttttggtttttgaatgttacaaaataaatattttaatttatacctatgtctaaaccttagcctagttaaagatttcccaactattttttccacctatcccttttttaaaagaaaaattacttaaagaatgaataaatgagatcctaaaagtgttgtcatcgaagacagtgagcca

SEQ ID NO: 286773 - DNA, 2043 bp, Homo sapiens
gagggcaggcgtgagcaaccatggccgggcagcacctcccggtaccccggctggagggcgtttctcgggagcagttcatgcagcacctctacccacagagaaaacctcttgtgttggaagggattgatttggggccatgtacaagcaaatggacagtggattacctaagccaagttggagggaagaaagaagtaaagattcatgttgctgcagttgcacagatggacttcattaaactttaccttttgaccagttggtccagagggcagctgaagagaaacataaagaattctttgtttcagaggatgagaaatactacttacggtcacttggagaagaccctagaaaggatgttgcagatatcagaaagcagtttcctttgttgaaaggagatattaagtttccagaattcttcaaagaggaacagttcttttccagtgtttttcgaattagttcaccaggattacaactatggactcattatgatctaaatcagaagtactgaatatagataacccagacttggctaaatatccacttttttccaaggctagaagatatgaatgttcccttgaagctggtgatgtattattcattcctgctttatggttccataatgtaatttctgaagagtttggagtgggagtgaatatcttttggaagcaccttccatctgaatgctatgataaaacagatacctatggaaacaaagatcctacagcagcatcaagagctgcacaaattctggacagagccttgaaaacactggccgagttaccagaggaatatagggacttctatgcacgacgaatggtcctacacattcaagacaaagcctacagcaagaactctgagtaaataatgaagtgaatgcaatgcacattaacactttagtaaggtataacgatataaattaaagattttgttaaaataggaaagatacatcagatttacagattatgtaagtacgaaggggtgtttgtgtggattctacttgatacagattgttataattaaagaatgctgtgctgggaccactctttaacattcagatgctgaccactaaaagtccaacttaaaatgacttaaaaacagtaagaaaatatattgattcacaatacatgaaatctattgacagaatgtgctgcagtgtttctgatccaatgattcagtaatgtcatcaagaaccttgggaacccgcctccacaccccacccccttttcaaccacaacattggcatcatcctaaggctggctaccctcgtggtcatgggatgattgccagtagcagttggagccttgtgcatcttcatttacatgcagcggaagagtcaggctggattctaggggccctgtcctagtatgagaaagctttcccagaattcactttccatatccttaggtctcattgctctaaagtaacttagacctgtccatccctgagccagtcactggcaaagggtctagaataacctttagggcagtcaggtccactggagctgagagtagaagtggaggccacatgagggatatatggggacagaaaggatagtttttttaaaatcatggttctgataggaaaaacatgagcaacgcacaatatctattacatttgcctagaagcagaattttttgaggaactttaaaaaatgtacagatacctaggtcccaactttgtagactgattcaagagtgtttgggatttggtataggaacttaatagacctcacagggtgttctgatgcataatcagagctgagatcaactggagttgatgatagtgacttggattattagttttgtgattagtgcaaaacaaatgtttaatctgatcttgacttttcttgccacccagtatgtcagggtggtttttggtttttgaatgttacaaaataaatattttaatttatacctatgtctaaaccttagcctagttaaagatttcccaactattttttccacctatcccttttttaaaagaaaaattacttaaagaatgaataaatgagatcctaaaagtgttgtcatcgaagacagtgagcca

SEQ ID NO: 286774 - DNA, 459 bp, Homo sapiens
gagggcaggcgtgagcaaccatggccgggcagcacctcccggtaccccggctggagggcgtttctcgggagcagttcatgcagcacctctacccacagagaaaacctcttgtgttggaagggattgatttggggccatgtacaagcaaatggacagtggattacctaagccaagttggagggaagaaagaagtaaagattcatgttgctgcagttgcacagatggacttcattaaactttaccttttgaccagttggtccagagggcagctgaagagaaacataaagaattctttgtttcagaggatgagaaatactacttacggtcacttggagaagaccctagaaaggtaagaattctaaatgtaaaacaattccctaaaatctaaatggatgtatgtatgttaactggcaacactgtaattttatacttactgcctgacatattccctgttctatc

SEQ ID NO: 286775 - DNA, 2153 bp, Homo sapiens
gagggcaggcgtgagcaaccatggccgggcagcacctcccggtaccccggctggagggcgtttctcgggagcagttcatgcagcacctctacccacagagaaaacctcttgtgttggaagggattgatttggggccatgtacaagcaaatggacagtggattacctaagccaagttggagggaagaaagaagtaaagattcatgttgctgcagttgcacagatggacttcattagtaagaactttgtatatagaactttaccttttgaccagttggtccagagggcagctgaagagaaacataaagaattctttgtttcagaggatgagaaatactacttacggtcacttggagaagaccctagaaaggatgttgcagatatcagaaagcagtttcctttgttgaaaggagatattaagtttccagaattcttcaaagaggaacagttcttttccagtgtttttcgaattagttcaccaggattacaactatggactcattatgatgtaatggataatttgttaatacaagtgacaggaaaaaagcgtgttgtactcttcagtcctcgagatgcccagtatttatatttaaaaggtactaaatcagaagtactgaatatagataacccagacttggctaaatatccacttttttccaaggctagaagatatgaatgttcccttgaagctggtgatgtattattcattcctgctttatggttccataatgtaatttctgaagagtttggagtgggagtgaatatcttttggaagcaccttccatctgaatgctatgataaaacagatacctatggaaacaaagatcctacagcagcatcaagagctgcacaaattctggacagagccttgaaaacactggccgagttaccagaggaatatagggacttctatgcacgacgaatggtcctacacattcaagacaaagcctacagcaagaactctgagtaaataatgaagtgaatgcaatgcacattaacactttagtaaggtataacgatataaattaaagattttgttaaaataggaaagatacatcagatttacagattatgtaagtacgaaggggtgtttgtgtggattctacttgatacagattgttataattaaagaatgctgtgctgggaccactctttaacattcagatgctgaccactaaaagtccaacttaaaatgacttaaaaacagtaagaaaatatattgattcacaatacatgaaatctattgacagaatgtgctgcagtgtttctgatccaatgattcagtaatgtcatcaagaaccttgggaacccgcctccacaccccacccccttttcaaccacaacattggcatcatcctaaggctggctaccctcgtggtcatgggatgattgccagtagcagttggagccttgtgcatcttcatttacatgcagcggaagagtcaggctggattctaggggccctgtcctagtatgagaaagctttcccagaattcactttccatatccttaggtctcattgctctaaagtaacttagacctgtccatccctgagccagtcactggcaaagggtctagaataacctttagggcagtcaggtccactggagctgagagtagaagtggaggccacatgagggatatatggggacagaaaggatagtttttttaaaatcatggttctgataggaaaaacatgagcaacgcacaatatctattacatttgcctagaagcagaattttttgaggaactttaaaaaatgtacagatacctaggtcccaactttgtagactgattcaagagtgtttgggatttggtataggaacttaatagacctcacagggtgttctgatgcataatcagagctgagatcaactggagttgatgatagtgacttggattattagttttgtgattagtgcaaaacaaatgtttaatctgatcttgacttttcttgccacccagtatgtcagggtggtttttggtttttgaatgttacaaaataaatattttaatttatacctatgtctaaaccttagcctagttaaagatttcccaactattttttccacctatcccttttttaaaagaaaaattacttaaagaatgaataaatgagatcctaaaagtgttgtcatcgaagacagtgagcca

SEQ ID NO: 286776 - DNA, 896 bp, Homo sapiens
cccaggacgatcatcttggttttctggtgctgctggggcttctcctccgtgctgtagctgcgctgagggcaggcagggaaagaagcgaaggctgcggggagtcccgggctgctgagcactggccaccgggagccctgggcaggtagcgccgaggctgccaaggccctagcgcttcgtggaaataacgccgctcccaagccgaggcgacagcggcagaagtagcaaagtgtggccgacggcagcctcacctcggccacagcaggagtccggagtcggacggccccgcagggcagcgaccgagagtgcaggaactggggtagcaaacgagcggccagcgccatttttatgacccttcaccccggtgcctgccggtgctgtatggaaaggaagtcggtgggaaaccgcctcagcggtgtcggagaaagagactggagagcaaagtggacctgttgctgcagcctctggtgagtcggccccgtccccgctctccagcacgcagcccaggccgaggcccttcggcaacccgccccgcgctcggacccagccactctggagtctgccggcctcgcggaccttttctctgtcgctcgtgtttccgggcggatggcgctgaggaacgctttagagccgaagttccgaagacctggaagagggcaggcgtgagcaaccatggccgggcagcacctcccggtaccccggctggagggcgtttctcgggagcagttcatgcagcacctctacccacaggtgaggccctcgcgcggggcagaacctcgagaaaccagcgagagacacgtctttacctttcggacagctgggaactggtttttagagacccagggtgtgggaaagaggcgcaggacggcagcagatcactggttggcccttagaccaag

SEQ ID NO: 286777 - DNA, 953 bp, Homo sapiens
gcggccgcccgtagcctaattgcgcagagggctcgccttgcacctcctcttcccccgccgccctccctctcgcccagaaaggaggacggacccagctgcaggctccgagctggtttattctgcggccgaggattacatttatgcacgaacgggcttactggttccagattccccacttgggcacaggcataggaggcttgttttccaaattgctggttttaattgcacctgcctttcagattacctctgggaatctgtgggaggagccgagagggtggaaaatgtttcttagctttgcaaaaggaagaaaactttgtcacccagcgggagacctcagccacgagtaacccggggagacaccagaaccgggacgggctttgactgatttgcctacgagggttccgtaggaaaggacgcttgaattcggcgcttcggcggcggcggcggccgcgcgagttccctgctcaccctccctctccgcggaagtccccacgaggtggcttcagggtgtaacagagcgcgcggctccagtccgaaggcagcggccgggggagggaaggaggggaccgaacccccgaggagtttcgcagaatcaacttctggttagagttatgggaagcgcggttatggacaccaagaagaaaaaagatgtttccagccccggcgggagcggcggcaagaaaaatgccagccagaagaggcgttcgctgcgcgtgcacattccgcactctcaacgccctgcgagcgccgacggttggatggagggagggtcgcccggattcacccccagctgccatccccgtgggccagcactgcctctttctctccctcttcttccaccttatcttcctgtccactttccccctttccctcccccataattgaccccaatgtggaattgagggtcatttcaaaatatttctgatactatttgaagaaaataaactttatct

SEQ ID NO: 286778 - DNA, 931 bp, Homo sapiens
gcggccgcccgtagcctaattgcgcagagggctcgccttgcacctcctcttcccccgccgccctccctctcgcccagaaaggaggacggacccagctgcaggctccgagctggtttattctgcggccgaggattacatttatgcacgaacgggcttactggttccagattccccacttgggcacaggcataggaggcttgttttccaaattgctggttttaattgcacctgcctttcagattacctctgggaatctgtgggaggagccgagagggtggaaaatgtttcttagctttgcaaaaggaagaaaactttgtcacccagcgggagacctcagccacgagtaacccggggagacaccagaaccgggacgggctttgactgatttgcctacgagggttccgtaggaaaggacgcttgaattcggcgcttcggcggcggcggcggccgcgcgagttccctgctcaccctccctctccgcggaagtccccacgaggtggcttcagggtgtaacagagcgcgcggctccagtccgaaggcagcggccgggggagggaaggaggggaccgaacccccgaggagtttcgcagaatcaacttctggttagagttatgggaagcgcggttatggacaccaagaagaaaaaagatgtttccagccccggcgggagcggcggcaagaaaaatgccagccagaagaggcgttcgctgcgcgtgcacattccggacctgagctccttcgccatgccgctcctggacggagacctggagggttccggaaagcattcctctcgaaaggtggacagccccttcggcccgggcagcccctccaaagggttcttcttcagaggcccccagccccggccctccagccccatgtctgcacctgtgaggcccaagaccagccccggctctcccaaaaccgtgttccc

SEQ ID NO: 286779 - DNA, 799 bp, Homo sapiens
  misc_feature (723)..(723): n is a, c, g, or t
gcggccgcccgtagcctaattgcgcagagggctcgccttgcacctcctcttcccccgccgccctccctctcgcccagaaaggaggacggacccagctgcaggctccgagctggtttattctgcggccgaggattacatttatgcacgaacgggcttactggttccagattccccacttgggcacaggcataggaggcttgttttccaaattgctggttttaattgcacctgcctttcagattacctctgggaatctgtgggaggagccgagagggtggaaaatgtttcttagctttgcaaaaggaagaaaactttgtcacccagcgggagacctcagccacgagtaacccggggagacaccagaaccgggacgggctttgactgatttgcctacgagggttccgtaggaaaggacgcttgaattcggcgcttcggcggcggcggcggccgcgcgagttccctgctcaccctccctctccgcggaagtccccacgaggtggcttcagggtgtaacagagcgcgcggctccagtccgaaggcagcggccgggggagggaaggaggggaccgaacccccgaggagtttcgcagaatcaacttctggttagagttatgggaagcgcggttatggacaccaagaagaaaaaagatgtttccagccggggcgcacgcgtgtgaaacaacaccgagcttgaatggtggaagtctttgaaccttttaccanatcagtttgttttctttagatttgcaaaaagttgtaatttgaatataaataattactttaaaattttatgacactt

SEQ ID NO: 286780 - DNA, 645 bp, Homo sapiens
ccagctttgtcactccaagagatggccctgggactgagaagtggatggcagctgtgacagcaggagaggactgcctgaggctccccgggcagaggctctggtgccaggttagcagcaggaccgacggcagacccagcagccagagagtgaaaggtgggtaaattgaggcccaaggagaggaatggacttgctgtggacattccaagagcccagaggcaactcaggccaaggcgagtctgtctgttctgaatctcttaggtcagttctgaatccaaacagtaaccggacaagcccattctcaggagctcctcagctccattccgtgggggcttggttacctgtaacagggcctcaacaggagggtcatagacttgcccattgcttccaagcaacagggagttggcattgccctgcctcctgtgggactcgcaaacataaaatctcaggctctctcattctcacatctacattacatagcactgactctgtgccggacactgttcttagtgctttgcaaatagtaatttatatagtcctcattgactgggaagctatattaattttgacattattcctgagaaaagcatatcccttcctgggttctggccctgttaacaggaatgttttaaaactttgtctctctga

SEQ ID NO: 286781 - DNA, 1028 bp, Homo sapiens
tcaacatttgtctggcatttgtttttaacttttgtcatagtcatggagggtttacagaacatttataagacgaaagcatgtgtttgaaacactccaatcctttggcttatttttgttctataatttgggaagagtcctctctttggctggtgggataccagagtcccataaggccatagttagataactactggcctaacataaggagggtttatttatttatttatttatttatttttagatggagtttcactcttgttgtccaggctggagtgcaatggcatgttctcggctcaccgcaacctccgcctcccagtttcaagcgattcttctgcctcagcctcccaagtagctgggattacaggcatgcgccaccatgcctgactaattttgtatttttagtagaaatggggtttctccatgttggtcaggctggtctcgaactcccgacctcaggtgatccgcccaccttggcctcccaaggaggtattaatagcaaggtggaagccttcatagagtctggaaagagagaaccagggaggaagcccaggtccccagtgctccagcgttgattgagggagaaagcttgaaaatgggaggaacacattttcccatctcttgagggaaatctgagtcactctcaggcctttccaggttcacagtgctctctctgcaaggctgttcatttgccagatttcccagaggtcacttagaaaccagcatcttgtgagtatagttagaatgagtcaagtcctagggctctggcgatcagctagaaggaattgatgaggtctaagagcctataaagctgactcgggccttgttgaccccattaggacacttgtttaacaagacatctgcccatgtccctggcccatctcattggctgcagcacatcacagtggaccttctgcctcctcccagatgcccagggacagtgatctggaaggaaggggcttgaggctgttttcctagaactcgagtaagtactgatgaaaatgatggacaggggatattaagccctcgtg

SEQ ID NO: 286782 - DNA, 821 bp, Homo sapiens
gagaggccgcgtcctcagctggtcctagacatgcgtggcgtcggggctgtggcacggtcgggtccggggacacttgtttaacaagacatctgcccatgtccctggcccatctcattggctgcagcacatcacagtggaccttctgcctcctcccagatgcccagggacagtgatctggaaggaaggggcttgaggctgttttcctagaactcgacttgaatgcaccaaggaaaggccatttgtggggacatagcaagaaggcagctgtctgcaagccaggaggagaaccctcaccagaaacctcacagaaatcggccaacaccctcatctcgggcttccagcttcagaacaacgagaaaacaaatttctgttgtgtcctggttcccatttgtaattggcaccctaatgaaaccgttttctgtagccctggaaatggctgaaaatgaggggagggaaataaagtgctataattcagagcatggagcacaccttcctggttcacctgagctggattcggagaggtaaaatggccattacctcgtctaagctgccacttacagacacagtacaggatgaggcccaggcccacagagacaacaatgatggccacagctaagatgatccagaaattattcctccaccagctcattgcagtggaatcctgagaagaatggagaaagaagaatgagagggcaaagcagatggctacaccgagaactcacgccagccaacacactttgatctcgaggctctggaagggaaggtgccctattgaactactgaaagccaagatgcaatgacaaagcagtcgtccaggtccc

SEQ ID NO: 286783 - DNA, 728 bp, Homo sapiens
gagaggccgcgtcctcagctggtcctagacatgcgtggcgtcggggctgtggcacggtcgggtccgggcttgaatgcaccaaggaaaggccatttgtggggacatagcaagaaggcagctgtctgcaagccaggaggagaaccctcaccagaaacctcacagaaatcggccaacaccctcatctcgggcttccagcttcagaacaacgagaaaacaaatttctgttgtgtcctggttcccatttgtaattggcaccctaatgaaaccgttttctgtagccctggaaatggctgaaaatgaggggagggaaataaagtgctataattcagagcatggagcacaccttcctggttcacctgagctggattcggagaggtaaaatggccattacctcgtctaagctgccacttacagacatctgcttaggaatcaggcactggatcacagccataccctactcattaacacctgggggacctcaggcatgtcactcgaccttctgtgagcctcatctataatatgggaatgatatctcctacttcactgaggtttgtgaggactggagatcgaacatgtacctactgggccctctagaaatggtagacatcatcactgctctttcagacatgcagcaggagggggaaggtgccatttaaagcaataattgactgcagggttgttttttttcttgagacggagtctcgctctgtaactcaggctggagtgca

SEQ ID NO: 286784 - DNA, 1544 bp, Homo sapiens
tcaacatttgtctggcatttgtttttaacttttgtcatagtcatggagggtttacagaacatttataagacgaaagcatgtgtttgaaacactccaatcctttggcttatttttgttctataatttgggaagagtcctctctttggctggtgggataccagagtcccataaggccatagttagataactactggcctaacataaggagggtttatttatttatttatttatttatttttagatggagtttcactcttgttgtccaggctggagtgcaatggcatgttctcggctcaccgcaacctccgcctcccagtttcaagcgattcttctgcctcagcctcccaagtagctgggattacaggcatgcgccaccatgcctgactaattttgtatttttagtagaaatggggtttctccatgttggtcaggctggtctcgaactcccgacctcaggtgatccgcccaccttggcctcccaaggaggtattaatagcaaggtggaagccttcatagagtctggaaagagagaaccagggaggaagcccaggtccccagtgctccagcgttgattgagggagaaagcttgaaaatgggaggaacacattttcccatctcttgagggaaatctgagtcactctcaggcctttccaggttcacagtgctctctctgcaaggctgttcatttgccagatttcccagaggtcacttagaaaccagcatcttgtgagtatagttagaatgagtcaagtcctagggctctggcgatcagctagaaggaattgatgaggtctaagagcctataaagctgactcgggccttgttgaccccattaggacacttgtttaacaagacatctgcccatgtccctggcccatctcattggctgcagcacatcacagtggaccttctgcctcctcccagatgcccagggacagtgatctggaaggaaggggcttgaggctgttttcctagaactcgacttgaatgcaccaaggaaaggccatttgtggggacatagcaagaaggcagctgtctgcaagccaggaggagaaccctcaccagaaacctcacagaaatcggccaacaccctcatctcgggcttccagcttcagaacaacgagaaaacaaatttctgttgtgtcctggttcccatttgtaattggcaccctaatgaaaccgttttctgtagccctggaaatggctgaaaatgaggggagggaaataaagtgctataattcagagcatggagcacaccttcctggttcacctgagctggattcggagaggtaaaatggccattacctcgtctaagctgccacttacagacacagtacaggatgaggcccaggcccacagagacaacaatgatggccacagctaagatgatccagaaattattcctccaccagctcattgcagtggaatcctgagaagaatgcaggagaatcacttgaaactggaaggcggaggttgcagtgagccgagatcatgccactgcattccagcctgggcgaaagagctaaactccgtctctcaaaaaa

SEQ ID NO: 286785 - DNA, 776 bp, Homo sapiens
gagaggccgcgtcctcagctggtcctagacatgcgtggcgtcggggctgtggcacggtcgggtccggggacacttgtttaacaagacatctgcccatgtccctggcccatctcattggctgcagcacatcacagtggaccttctgcctcctcccagatgcccagggacagtgatctggaaggaaggggcttgaggctgttttcctagaactcgacttgaatgcaccaaggaaaggccatttgtggggacatagcaagaaggcagctgtctgcaagccaggaggagaaccctcaccagaaacctcacagaaatcggccaacaccctcatctcgggcttccagcttcagaacaacgagaaaacaaatttctgttgtgtcctggttcccatttgtaattggcaccctaatgaaaccgttttctgtagccctggaaatggctgaaaatgaggggagggaaataaagtgctataattcagagcatggagcacaccttcctggttcacctgagctggattcggagaggtaaaatggccattacctcgtctaagctgccacttacagacacagtacaggatgaggcccaggcccacagagacaacaatgatggccacagctaagatgatccagaaattattcctccaccagctcattgcagtggaatcctgagaagaatgcaggagaatcacttgaaactggaaggcggaggttgcagtgagccgagatcatgccactgcattccagcctgggcgaaagagctaaactccgtctctcaaaaaa

SEQ ID NO: 286786 - DNA, 1753 bp, Homo sapiens
tcaacatttgtctggcatttgtttttaacttttgtcatagtcatggagggtttacagaacatttataagacgaaagcatgtgtttgaaacactccaatcctttggcttatttttgttctataatttgggaagagtcctctctttggctggtgggataccagagtcccataaggccatagttagataactactggcctaacataaggagggtttatttatttatttatttatttatttttagatggagtttcactcttgttgtccaggctggagtgcaatggcatgttctcggctcaccgcaacctccgcctcccagtttcaagcgattcttctgcctcagcctcccaagtagctgggattacaggcatgcgccaccatgcctgactaattttgtatttttagtagaaatggggtttctccatgttggtcaggctggtctcgaactcccgacctcaggtgatccgcccaccttggcctcccaaggaggtattaatagcaaggtggaagccttcatagagtctggaaagagagaaccagggaggaagcccaggtccccagtgctccagcgttgattgagggagaaagcttgaaaatgggaggaacacattttcccatctcttgagggaaatctgagtcactctcaggcctttccaggttcacagtgctctctctgcaaggctgttcatttgccagatttcccagaggtcacttagaaaccagcatcttgtgagtatagttagaatgagtcaagtcctagggctctggcgatcagctagaaggaattgatgaggtctaagagcctataaagctgactcgggccttgttgaccccattaggacacttgtttaacaagacatctgcccatgtccctggcccatctcattggctgcagcacatcacagtggaccttctgcctcctcccagatgcccagggacagtgatctggaaggaaggggcttgaggctgttttcctagaactcgacttgaatgcaccaaggaaaggccatttgtggggacatagcaagaaggcagctgtctgcaagccaggaggagaaccctcaccagaaacctcacagaaatcggccaacaccctcatctcgggcttccagcttcagaacaacgagaaaacaaatttctgttgtgtcctggttcccatttgtaattggcaccctaatgaaaccgttttctgtagccctggaaatggctgaaaatgaggggagggaaataaagtgctataattcagagcatggagcacaccttcctggttcacctgagctggattcggagaggtaaaatggccattacctcgtctaagctgccacttacagacacagtacaggatgaggcccaggcccacagagacaacaatgatggccacagctaagatgatccagaaattattcctccaccagctcattgcagtggaatcctgagaagaatggagaaagaagaatgagcttcttgcatgactgcctgaaatccgcctcctgtcagatcagcaggggcattggattatgataggagtgagaacaccattgtggactgcgcatgccagggatctaggttccgcgctccttatgagaatctgatgcctgatgatctgtcactgtctcccatcacccccagatgggactgtctagttgaagaaaaacaagttcagggctcccactgatgctacgttacggtgagttgtataattatttcattataattacaatgtaatgataatagaaataaagggcacaataaatat

SEQ ID NO: 286787 - DNA, 576 bp, Homo sapiens
  misc_feature (250)..(250): n is a, c, g, or t
  misc_feature (521)..(521): n is a, c, g, or t
  misc_feature (576)..(576): n is a, c, g, or t
tgaacaagaagttgtttcttcacctgtacaagtgttgatggtggatgggctaggctagttgtggtgaaaaagaccacattcaggacctgttttggagatatgccactaagacttgctaatgaggtgtatatgggaatgagagaagggaagatcatcagagacttctagacttacggcttgagcaatgagtgaatagtgttgcactcaagagtgcgaatgagcagggagggcaacaggttccagaggaaangaagaactttattttggacacttggggttgagactctgttagacccagaaggaagattgacagctcctacaagtgtactcaggtgatgaccgactgagatgtctctggaggtgcgatccactgtgagaagacctgcagaagggcaggcttcctgaagagtcatcatgactccaacactgacatattctgaccactagagactgaattggagttactgatgacaactccatgctgtttgggtcagccagcttgacaaaacatgctgacacancaatcacgtgtcacaacaccagactcacagacaacattttcatggacactgagcn

SEQ ID NO: 286788 - DNA, 1745 bp, Homo sapiens
  misc_feature (921)..(921): n is a, c, g, or t
  misc_feature (993)..(993): n is a, c, g, or t
ctcaccccagacactcactgcaccggagtgagcgcgaccatcatgtccatgctcgtggtctttctcttgctgtggggtgtcacctggggcccagtgacagaagcagccatattttatgagacgcagcccagcctgtgggcagagtccgaatcactgctgaaacccttggccaatgtgacgctgacgtgccaggcccgcctggagactccagacttccagctgttcaagaatggggtggcccaggagcctgtgcaccttgactcacctgccatcaagcaccagttcctgctgacgggtgacacccagggccgctaccgctgccgctcgggcttgtccacaggatggacccagctgagcaagctcctggagctgacagggccaaagtccttgcctgctccctggctctcgatggcgccagtgtcctggatcacccccggcctgaaaacaacagcagtgtgccgaggtgtgctgcggggtgtgacttttctgctgaggcgggagggcgaccatgagtttctggaggtgcctgaggcccaggaggatgtggaggccacctttccagtccatcagcctggcaactacagctgcagctaccggaccgatggggaaggcgccctctctgagcccagcgctactgtgaccattgaggagctcgctgcaccaccaccgcctgtgctgatgcaccatggagagtcctcccaggtcctgcaccctggcaacaaggtgaccctcacctgcgtggctcccctgagtggagtggacttccagctacggcgcggggagaaagagctgctggtacccaggagcagcaccagcccagatcgcatcttctttcacctgaacgcggtggccctgggggatggaggtcactacacctgccgctaccggctgcatgacaaccaaaacggctggtccgggganagcgcgccggtcgagctgattctgagcgatgagacgctgcccgcgccggagttctccccggagccggagtcnggcagggccttgcggctgcggtgcctggcgcccctggagggcgcgcgcttcgccctggtgcgcgaggacaggggcgggcgccgcgtgcaccgtttccagagccccgctgggaccgaggcgctcttcgagctgcacaacatttccgtggctgactccgccaactacagctgcgtctacgtggacctgaagccgcctttcgggggctccgcgcccagcgagcgcttggagctgcacgtggacggaccccctcccaggcctcagctccgggcgacgtggagtggggcggtcctggcgggccgagatgccgtcctgcgctgcgagggacccatccccgacgtcaccttcgagctgctgcgcgagggcgagacgaaggccgtgaagacggtccgcacccccggggccgcggcgaacctcgagctgatcttcgtggggccccagcacgccggcaactacaggtgccgctaccgctcctgggtgccccacaccttcgaatcggagctcagcgaccctgtggagctcctggtggcagaaagctgatgcagccgcgggcccagggtgctgttggtgtcctcagaagtgccggggattctggactggctccctcccctcctgttgcagcacaaggccggggtctctggggggctggagaagcctccctcattcctcccaggaattaataaatgtgaagagagctctgtttaaaatgtctttggactcccagggctgagtgggctgggatctcgtgtcctcaa

SEQ ID NO: 286789 - DNA, 1399 bp, Homo sapiens
  misc_feature (921)..(921): n is a, c, g, or t
  misc_feature (993)..(993): n is a, c, g, or t
  misc_feature (1296)..(1296): n is a, c, g, or t
  misc_feature (1347)..(1347): n is a, c, g, or t
  misc_feature (1375)..(1375): n is a, c, g, or t
  misc_feature (1394)..(1394): n is a, c, g, or t
ctcaccccagacactcactgcaccggagtgagcgcgaccatcatgtccatgctcgtggtctttctcttgctgtggggtgtcacctggggcccagtgacagaagcagccatattttatgagacgcagcccagcctgtgggcagagtccgaatcactgctgaaacccttggccaatgtgacgctgacgtgccaggcccgcctggagactccagacttccagctgttcaagaatggggtggcccaggagcctgtgcaccttgactcacctgccatcaagcaccagttcctgctgacgggtgacacccagggccgctaccgctgccgctcgggcttgtccacaggatggacccagctgagcaagctcctggagctgacagggccaaagtccttgcctgctccctggctctcgatggcgccagtgtcctggatcacccccggcctgaaaacaacagcagtgtgccgaggtgtgctgcggggtgtgacttttctgctgaggcgggagggcgaccatgagtttctggaggtgcctgaggcccaggaggatgtggaggccacctttccagtccatcagcctggcaactacagctgcagctaccggaccgatggggaaggcgccctctctgagcccagcgctactgtgaccattgaggagctcgctgcaccaccaccgcctgtgctgatgcaccatggagagtcctcccaggtcctgcaccctggcaacaaggtgaccctcacctgcgtggctcccctgagtggagtggacttccagctacggcgcggggagaaagagctgctggtacccaggagcagcaccagcccagatcgcatcttctttcacctgaacgcggtggccctgggggatggaggtcactacacctgccgctaccggctgcatgacaaccaaaacggctggtccgggganagcgcgccggtcgagctgattctgagcgatgagacgctgcccgcgccggagttctccccggagccggagtcnggcagggccttgcggctgcggtgcctggcgcccctggagggcgcgcgcttcgccctggtgcgcgaggacaggggcgggcgccgcgtgcaccgtttccagagccccgctgggaccgaggcgctcttcgagctgcacaacatttccgtggctgactccgccaactacagctgcgtctacgtggacctgaagccgcctttcgggggctccgcgcccagcgagcgcttggagctgcacgtggacggaccccctcccagcctcagccccggcacttctgaggacaccaacagcaccctggcccgcggntgcatcagctttctgccaccaggagctccacagggtgctgagctccgattngaaggtgtggggcacccaggagcggtanggcacctgtagttgcctgncgtgc

SEQ ID NO: 286790 - DNA, 3004 bp, Homo sapiens
gaaaaggcaaatctacccttcacagaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaactgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgtttaaaaaacaaaaacaaaaaaaaaacacacaaacctaagtagaatacattattttgcatgaaggaatgtcatttctgagctttttacacctaaaattaggctgaaatagctgagataattaatttggaacctatcaatttgagtggactttttctttagtagtacaccattttggttgttgtagtttcaaagtctttctgaagcagatatattgggattggagcggggtggggaaaactgtcactcctttcagaggaaaaggggaggagcatggagaaaaacaaaaattaaaggacttaaagaatggctatacagtgttgagtgttgaggatattaaacatgttatttttcaaacgtatgtaatatatattaaatttataaagcaaatttatgttgtgatcttgcctgaacaaattatattttaatgaaaaaactttctattaatagttcacgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtatttaaaagtctttctgtattttaagacttgtgcaaccagatgttacccttttatcattaaaactttttaaaatcattttttctcacagtaaacataaaaaaaaacccagtcaagtagaaaattttaccatgtaatatatgtataaaaaacacaaagcactcctttataatagtcatcaatgtacatttattgaggaaaccataatgaatacaaaattacagcaatcatgtgaccttttacatacaatgtcattaaagcaaactctaaaccac

SEQ ID NO: 286791 - DNA, 2640 bp, Homo sapiens
gtactttagaaaccatgaattaactacccacattaaccccactccaccaaaactgctctagaccttatcattaccaaattattattttcctagacacactatttgacagttgagactctgctcttaaatcactcccttattagcatttcgcccttccaattcacccctcagatgactcaaacatattttacttagtgatttccccatgtttcagccattgcctctttcaacagttgtctctacctgtttttctacttgtaaacacccttcccctgccatttcaccatcaatacattatttggagggaattcattagggacatagttctaagaagggtaaagaaggaaaatcattaagtgagaaaacatttattatgcagtagggaatggtatggacttacaggaatcaagggagtacttttaacaattatttagaatgtatagcattctgacctttttcagttaagtgctatcaaaaccaagcagagttggtaggacaaacaggctaggatcccagtgatattgtgatctttacatttggagaaaaagtctataactaagagaatgcttcataaatgtatctatcacttttcctgaactggagagttagaaaaaatctgagtgtctgcagtgtagcaaaaatatgcattataaacatgttaatcattttgtgcttctaaacacctttagaactagtaacgcttctttgtttttagaaggcaagcaattgttaatcttggcccactttcttgcaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaagtaagaattaatcactctttttatcttttattctattaatttttttttccttaaaatcacttttcttcttctcttttttagctgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgtttaaaaaacaaaaacaaaaaaaaaacacacaaacctaagtagaatacattattttgcatgaaggaatgtcatttctgagctttttacacctaaaattaggctgaaatagctgagataattaatttggaacctatcaatttgagtggactttttctttagtagtacaccattttggttgttgtagtttcaaagtctttctgaagcagatatattgggattggagcggggtggggaaaactgtcactcctttcagaggaaaaggggaggagcatggagaaaaacaaaaattaaaggacttaaagaatggctatacagtgttgagtgttgaggatattaaacatgttatttttcaaacgtatgtaatatatattaaatttataaagcaaatttatgttgtgatcttgcctgaacaaattatattttaatgaaaaaactttctattaatagttcacgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtatttaaaagtctttctgtattttaagacttgtgcaaccagatgttacccttttatcattaaaactttttaaaatcattttttctcacagtaaacataaaaaaaaacccagtcaagtagaaaattttaccatgtaatatatgtataaaaaacacaaagcactcctttataatagtcatcaatgtacatttattgaggaaaccataatgaatacaaaattacagcaatcatgtgaccttttacatacaatgtcattaaagcaaactctaaaccac

SEQ ID NO: 286792 - DNA, 269 bp, Homo sapiens
  misc_feature (2)..(2): n is a, c, g, or t
cntcgaggatccccgctgtgcggaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggaagttgaggatggtccgcacaggggtac

SEQ ID NO: 286793 - DNA, 867 bp, Homo sapiens
cccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaaaaccaaacaaaaaaacaaaaaaaaaacacacaccaaacaacacccgaaaaatacactaaacccaggtgacgtagtgcgaaaaaagatatattaaatcaacagacagccaaggagcgagggcagccccaatccaagcagacgagaacaaaacaaaaccgtgagagtacacaaagataatatatcccatcgaacaagcaacccccggcgaatgcgagaaactaaaaacaacacccgcagtggtagtacatccacaacaaccaatacgagaagaaagaccagctgtaaacgaccgaaaacggcagaagagataccccccactgcgacagagca

SEQ ID NO: 286794 - DNA, 466 bp, Homo sapiens
cccagcggctggagcagaagtgttagcggccagagctcccagacccctacccacagccaggcgggacgcgcacagtccctccacgcggaaagaagtaccttcgccggtcaccggctcctgcagggggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttac

SEQ ID NO: 286795 - DNA, 157 bp, Homo sapiens
ccattccttatttctgcctctttactgcagtctctagacaagaaaaccgaaagaagcaagctgaagaggaagcaagaaaacgtttagaagaagagaagcgtgcttttgaagaagcaaggcggcaaatggaagttgaggatggtccgcacaggggtac

SEQ ID NO: 286796 - DNA, 3535 bp, Homo sapiens
cccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattctgctttcttcatctaaacctgtcccaaaaacctatgtaccaaaacttggcaagggtgatgtaaaggataagtttgaagccatgcagagagccagggaagaaagaaatcaaaggagatctagagacgaaaaacaaagaagaaaagaacaatatattagagagagagaatggaacaggagaaagcaggagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaagtaagaattaatcactctttttatcttttattctattaatttttttttccttaaaatcacttttcttcttctcttttttagctgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgtttaaaaaacaaaaacaaaaaaaaaacacacaaacctaagtagaatacattattttgcatgaaggaatgtcatttctgagctttttacacctaaaattaggctgaaatagctgagataattaatttggaacctatcaatttgagtggactttttctttagtagtacaccattttggttgttgtagtttcaaagtctttctgaagcagatatattgggattggagcggggtggggaaaactgtcactcctttcagaggaaaaggggaggagcatggagaaaaacaaaaattaaaggacttaaagaatggctatacagtgttgagtgttgaggatattaaacatgttatttttcaaacgtatgtaatatatattaaatttataaagcaaatttatgttgtgatcttgcctgaacaaattatattttaatgaaaaaactttctattaatagttcacgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtatttaaaagtctttctgtattttaagacttgtgcaaccagatgttacccttttatcattaaaactttttaaaatcattttttctcacagtaaacataaaaaaaaacccagtcaagtagaaaattttaccatgtaatatatgtataaaaaacacaaagcactcctttataatagtcatcaatgtacatttattgaggaaaccataatgaatacaaaattacagcaatcatgtgaccttttacatacaatgtcattaaagcaaactctaaaccac

SEQ ID NO: 286797 - DNA, 3493 bp, Homo sapiens
cccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattctgctttcttcatctaaacctgtcccaaaaacctatgtaccaaaacttggcaagggtgatgtaaaggataagtttgaagccatgcagagagccagggaagaaagaaatcaaaggagatctagagacgaaaaacaaagaagaaaagaacaatatattagagagagagaatggaacaggagaaagcaggagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaagtaagaattaatcactctttttatcttttattctattaatttttttttccttaaaatcacttttcttcttctcttttttagctgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgtttaaaaaacaaaaacaaaaaaaaaacacacaaacctaagtagaatacattattttgcatgaaggaatgtcatttctgagctttttacacctaaaattaggctgaaatagctgagataattaatttggaacctatcaatttgagtggactttttctttagtagtacaccattttggttgttgtagtttcaaagtctttctgaagcagatatattgggattggagcggggtggggaaaactgtcactcctttcagaggaaaaggggaggagcatggagaaaaacaaaaattaaaggacttaaagaatggctatacagtgttgagtgttgaggatattaaacatgttatttttcaaacgtatgtaatatatattaaatttataaagcaaatttatgttgtgatcttgcctgaacaaattatattttaatgaaaaaactttctattaatagttcacgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtatttaaaagtctttctgtattttaagacttgtgcaaccagatgttacccttttatcattaaaactttttaaaatcattttttctcacagtaaacataaaaaaaaacccagtcaagtagaaaattttaccatgtaatatatgtataaaaaacacaaagcactcctttataatagtcatcaatgtacatttattgaggaaaccataatgaatacaaaattacagcaatcatgtgaccttttacatacaatgtcattaaagcaaactctaaaccac

SEQ ID NO: 286798 - DNA, 3065 bp, Homo sapiens
  misc_feature (13)..(13): n is a, c, g, or t
ctggtaaactcanactcaggtttgaagaaatggaaaggcaaagaagagaagatgaaaaaaggaaagcagaagaagaagccagaaggagaatagaggaagaaaagaaggcgtttgctgaagcaaggagaaatatggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaagtaagaattaatcactctttttatcttttattctattaatttttttttccttaaaatcacttttcttcttctcttttttagctgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgtttaaaaaacaaaaacaaaaaaaaaacacacaaacctaagtagaatacattattttgcatgaaggaatgtcatttctgagctttttacacctaaaattaggctgaaatagctgagataattaatttggaacctatcaatttgagtggactttttctttagtagtacaccattttggttgttgtagtttcaaagtctttctgaagcagatatattgggattggagcggggtggggaaaactgtcactcctttcagaggaaaaggggaggagcatggagaaaaacaaaaattaaaggacttaaagaatggctatacagtgttgagtgttgaggatattaaacatgttatttttcaaacgtatgtaatatatattaaatttataaagcaaatttatgttgtgatcttgcctgaacaaattatattttaatgaaaaaactttctattaatagttcacgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtatttaaaagtctttctgtattttaagacttgtgcaaccagatgttacccttttatcattaaaactttttaaaatcattttttctcacagtaaacataaaaaaaaacccagtcaagtagaaaattttaccatgtaatatatgtataaaaaacacaaagcactcctttataatagtcatcaatgtacatttattgaggaaaccataatgaatacaaaattacagcaatcatgtgaccttttacatacaatgtcattaaagcaaactctaaaccac

SEQ ID NO: 286799 - DNA, 3022 bp, Homo sapiens
tagaggatccccttattgccttcttaatggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaagtaagaattaatcactctttttatcttttattctattaatttttttttccttaaaatcacttttcttcttctcttttttagctgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgtttaaaaaacaaaaacaaaaaaaaaacacacaaacctaagtagaatacattattttgcatgaaggaatgtcatttctgagctttttacacctaaaattaggctgaaatagctgagataattaatttggaacctatcaatttgagtggactttttctttagtagtacaccattttggttgttgtagtttcaaagtctttctgaagcagatatattgggattggagcggggtggggaaaactgtcactcctttcagaggaaaaggggaggagcatggagaaaaacaaaaattaaaggacttaaagaatggctatacagtgttgagtgttgaggatattaaacatgttatttttcaaacgtatgtaatatatattaaatttataaagcaaatttatgttgtgatcttgcctgaacaaattatattttaatgaaaaaactttctattaatagttcacgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtatttaaaagtctttctgtattttaagacttgtgcaaccagatgttacccttttatcattaaaactttttaaaatcattttttctcacagtaaacataaaaaaaaacccagtcaagtagaaaattttaccatgtaatatatgtataaaaaacacaaagcactcctttataatagtcatcaatgtacatttattgaggaaaccataatgaatacaaaattacagcaatcatgtgaccttttacatacaatgtcattaaagcaaactctaaaccac

SEQ ID NO: 286800 - DNA, 3481 bp, Homo sapiens
cccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattctgctttcttcatctaaacctgtcccaaaaacctatgtaccaaaacttggcaagggtgatgtaaaggataagtttgaagccatgcagagagccagggaagaaagaaatcaaaggagatctagagacgaaaaacaaagaagaaaagaacaatatattagagagagagaatggaacaggagaaagcaggagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttagagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaagtaagaattaatcactctttttatcttttattctattaatttttttttccttaaaatcacttttcttcttctcttttttagctgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgtttaaaaaacaaaaacaaaaaaaaaacacacaaacctaagtagaatacattattttgcatgaaggaatgtcatttctgagctttttacacctaaaattaggctgaaatagctgagataattaatttggaacctatcaatttgagtggactttttctttagtagtacaccattttggttgttgtagtttcaaagtctttctgaagcagatatattgggattggagcggggtggggaaaactgtcactcctttcagaggaaaaggggaggagcatggagaaaaacaaaaattaaaggacttaaagaatggctatacagtgttgagtgttgaggatattaaacatgttatttttcaaacgtatgtaatatatattaaatttataaagcaaatttatgttgtgatcttgcctgaacaaattatattttaatgaaaaaactttctattaatagttcacgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtatttaaaagtctttctgtattttaagacttgtgcaaccagatgttacccttttatcattaaaactttttaaaatcattttttctcacagtaaacataaaaaaaaacccagtcaagtagaaaattttaccatgtaatatatgtataaaaaacacaaagcactcctttataatagtcatcaatgtacatttattgaggaaaccataatgaatacaaaattacagcaatcatgtgaccttttacatacaatgtcattaaagcaaactctaaaccac

SEQ ID NO: 286801 - DNA, 3229 bp, Homo sapiens
cccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattctgctttcttcatctaaacctgtcccaaaaacctatgtaccaaaacttggcaagggtgatgtaaaggataagtttgaagccatgcagagagccagggaagaaagaaatcaaaggagatctagagacgaaaaacaaagaagaaaagaacaatatattagagagagagaatggaacaggagaaagcaggagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaagtaagaattaatcactctttttatcttttattctattaatttttttttccttaaaatcacttttcttcttctcttttttagctgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgtttaaaaaacaaaaacaaaaaaaaaacacacaaacctaagtagaatacattattttgcatgaaggaatgtcatttctgagctttttacacctaaaattaggctgaaatagctgagataattaatttggaacctatcaatttgagtggactttttctttagtagtacaccattttggttgttgtagtttcaaagtctttctgaagcagatatattgggattggagcggggtggggaaaactgtcactcctttcagaggaaaaggggaggagcatggagaaaaacaaaaattaaaggacttaaagaatggctatacagtgttgagtgttgaggatattaaacatgttatttttcaaacgtatgtaatatatattaaatttataaagcaaatttatgttgtgatcttgcctgaacaaattatattttaatgaaaaaactttctattaatagttcacgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtatttaaaagtctttctgtattttaagacttgtgcaaccagatgttacccttttatcattaaaactttttaaaatcattttttctcacagtaaacataaaaaaaaacccagtcaagtagaaaattttaccatgtaatatatgtataaaaaacacaaagcactcctttataatagtcatcaatgtacatttattgaggaaaccataatgaatacaaaattacagcaatcatgtgaccttttacatacaatgtcattaaagcaaactctaaaccac

SEQ ID NO: 286802 - DNA, 3272 bp, Homo sapiens
cccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattctgctttcttcatctaaacctgtcccaaaaacctatgtaccaaaacttggcaagggtgatgtaaaggataagtttgaagccatgcagagagccagggaagaaagaaatcaaaggagatctagagacgaaaaacaaagaagaaaagaacaatatattagagagagagaatggaacaggagaaagcaggagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcagaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgtttaaaaaacaaaaacaaaaaaaaaacacacaaacctaagtagaatacattattttgcatgaaggaatgtcatttctgagctttttacacctaaaattaggctgaaatagctgagataattaatttggaacctatcaatttgagtggactttttctttagtagtacaccattttggttgttgtagtttcaaagtctttctgaagcagatatattgggattggagcggggtggggaaaactgtcactcctttcagaggaaaaggggaggagcatggagaaaaacaaaaattaaaggacttaaagaatggctatacagtgttgagtgttgaggatattaaacatgttatttttcaaacgtatgtaatatatattaaatttataaagcaaatttatgttgtgatcttgcctgaacaaattatattttaatgaaaaaactttctattaatagttcacgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtatttaaaagtctttctgtattttaagacttgtgcaaccagatgttacccttttatcattaaaactttttaaaatcattttttctcacagtaaacataaaaaaaaacccagtcaagtagaaaattttaccatgtaatatatgtataaaaaacacaaagcactcctttataatagtcatcaatgtacatttattgaggaaaccataatgaatacaaaattacagcaatcatgtgaccttttacatacaatgtcattaaagcaaactctaaaccac

SEQ ID NO: 286803 - DNA, 3482 bp, Homo sapiens
cccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattctgctttcttcatctaaacctgtcccaaaaacctatgtaccaaaacttggcaagggtgatgtaaaggataagtttgaagccatgcagagagccagggaagaaagaaatcaaaggagatctagagacgaaaaacaaagaagaaaagaacaatatattagagagagagaatggaacaggagaaagcaggagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaagtaagaattaatcactctttttatcttttattctattaatttttttttccttaaaatcacttttcttcttctcttttttagctgatgactactagctcccctcccctctccctggaactttctctttcactccaactttcttactacatccatcttttctgtggcggggccaatcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgtttaaaaaacaaaaacaaaaaaaaaacacacaaacctaagtagaatacattattttgcatgaaggaatgtcatttctgagctttttacacctaaaattaggctgaaatagctgagataattaatttggaacctatcaatttgagtggactttttctttagtagtacaccattttggttgttgtagtttcaaagtctttctgaagcagatatattgggattggagcggggtggggaaaactgtcactcctttcagaggaaaaggggaggagcatggagaaaaacaaaaattaaaggacttaaagaatggctatacagtgttgagtgttgaggatattaaacatgttatttttcaaacgtatgtaatatatattaaatttataaagcaaatttatgttgtgatcttgcctgaacaaattatattttaatgaaaaaactttctattaatagttcacgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtatttaaaagtctttctgtattttaagacttgtgcaaccagatgttacccttttatcattaaaactttttaaaatcattttttctcacagtaaacataaaaaaaaacccagtcaagtagaaaattttaccatgtaatatatgtataaaaaacacaaagcactcctttataatagtcatcaatgtacatttattgaggaaaccataatgaatacaaaattacagcaatcatgtgaccttttacatacaatgtcattaaagcaaactctaaaccac

SEQ ID NO: 286804 - DNA, 3118 bp, Homo sapiens
cccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattctgctttcttcatctaaacctgtcccaaaaacctatgtaccaaaacttggcaagggtgatgtaaaggataagtttgaagccatgcagagagccagggaagaaagaaatcaaaggagatctagagacgaaaaacaaagaagaaaagaacaatatattagagagagagaatggaacaggagaaagcaggagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacaggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaagtaagaattaatcactctttttatcttttattctattaatttttttttccttaaaatcacttttcttcttctcttttttagctgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgtttaaaaaacaaaaacaaaaaaaaaacacacaaacctaagtagaatacattattttgcatgaaggaatgtcatttctgagctttttacacctaaaattaggctgaaatagctgagataattaatttggaacctatcaatttgagtggactttttctttagtagtacaccattttggttgttgtagtttcaaagtctttctgaagcagatatattgggattggagcggggtggggaaaactgtcactcctttcagaggaaaaggggaggagcatggagaaaaacaaaaattaaaggacttaaagaatggctatacagtgttgagtgttgaggatattaaacatgttatttttcaaacgtatgtaatatatattaaatttataaagcaaatttatgttgtgatcttgcctgaacaaattatattttaatgaaaaaactttctattaatagttcacgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtatttaaaagtctttctgtattttaagacttgtgcaaccagatgttacccttttatcattaaaactttttaaaatcattttttctcacagtaaacataaaaaaaaacccagtcaagtagaaaattttaccatgtaatatatgtataaaaaacacaaagcactcctttataatagtcatcaatgtacatttattgaggaaaccataatgaatacaaaattacagcaatcatgtgaccttttacatacaatgtcattaaagcaaactctaaaccac

SEQ ID NO: 286805 - DNA, 1940 bp, Homo sapiens
ctacttatcgactatattaccccaccaccaccggaaaaaacacaacaaactgagggagcagcatgttgtgttttgcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaagtaagaattaatcactctttttatcttttattctattaatttttttttccttaaaatcacttttcttcttctcttttttagctgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgtttaaaaaacaaaaacaaaaaaaaaacacacaaacctaagtagaatacattattttgcatgaaggaatgtcatttctgagctttttacacctaaaattaggctgaaatagctgagataattaatttggaacctatcaatttgagtggactttttctttagtagtacaccattttggttgttgtagtttcaaagtctttctgaagcagatatattgggattggagcggggtggggaaaactgtcactcctttcagaggaaaaggggaggagcatggagaaaaacaaaaattaaaggacttaaagaatggctatacagtgttgagtgttgaggatattaaacatgttatttttcaaacgtatgtaatatatattaaatttataaagcaaatttatgttgtgatcttgcctgaacaaattatattttaatgaaaaaactttctattaatagttcacgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtatttaaaagtctttctgtattttaagacttgtgcaaccagatgttacccttttatcattaaaactttttaaaatcattttttctcacagtaaacataaaaaaaaacccagtcaagtagaaaattttaccatgtaatatatgtataaaaaacacaaagcactcctttataatagtcatcaatgtacatttattgaggaaaccataatgaatacaaaattacagcaatcatgtgaccttttacatacaatgtcattaaagcaaactctaaaccac

SEQ ID NO: 286806 - DNA, 1671 bp, Homo sapiens
cccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattctgctttcttcatctaaacctgtcccaaaaacctatgtaccaaaacttggcaagggtgatgtaaaggataagtttgaagccatgcagagagccagggaagaaagaaatcaaaggagatctagagacgaaaaacaaagaagaaaagaacaatatattagagagagagaatggaacaggagaaagcaggagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggtatattacctttatatttaac

SEQ ID NO: 286807 - DNA, 1467 bp, Homo sapiens
cccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattctgctttcttcatctaaacctgtcccaaaaacctatgtaccaaaacttggcaagggtgatgtaaaggataagtttgaagccatgcagagagccagggaagaaagaaatcaaaggagatctagagacgaaaaacaaagaagaaaagaacaatatattagagagagagaatggaacaggagaaagcaggagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtaagacagaagctaactggagaatgctattagaattcacctttgagaatatgttaatagaatcattagactttagagaataccctattatttctggaaactgtgccaagagtagaaatggcaaatatgttttaaagtctcccatggaataacaccagttggttgaaggtatttgcttcaatttagtgttcagaagattctgctttaaattgccatgcttggcacaaaggatggaatattatctcccttctctgggaaggcatgttttccagaactaagg

SEQ ID NO: 286808 - DNA, 1027 bp, Homo sapiens
cccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattctgctttcttcatctaaacctgtcccaaaaacctatgtaccaaaacttggcaagggtgatgtaaaggataagtttgaagccatgcagagagccagggaagaaagaaatcaaaggagatctagagacgaaaaacaaagaagaaaagaacaatatattagagagagagaatggaacaggagaaagcaggagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggaagttgaggatggtccgcacaggggtac

SEQ ID NO: 286809 - DNA, 176 bp, Homo sapiens
cataataacattgatgacagtgtaatgaaattcacctatgatggaggtaaagtcccatgaaacccaattttgattaagaagaaataggctaattatctattttataaaataggaaggagatgattcactacttataactgtggtacctgtcaaatcatataaaacatctggaaaaa

SEQ ID NO: 286810 - DNA, 237 bp, Homo sapiens
tcacattaaccacatttcacattaactataactaaaatacttttctgtatttgtaacctaatttaaactctgcatataatgtgatttagtctaatttttggacatgtgctcacattaatttatttaaccatctagattaaagaaatgcttgcttctgatgatgaggaagatgtatcttctaaagtagaaaaggcttatgttccaaaattaacaggtaagaagcttgaggggtaaata

SEQ ID NO: 286811 - DNA, 1010 bp, Homo sapiens
ttccccagggaaaaacagagattggcacaatctttgtaaatatctggcagtctttattgaaagcctgaacaatgttcatacctttggctgtggtcatttcgctcttagaaatatagcctaaagtacaattgcaaccaagatgaatgtgccagagacgttcagcacagtggtattgcagcatcaaactggaaataaactgaatatcaaaagggaacaattaaatcaagcgtagcttgaagaagctacatgtctaaggtgtatatgaaacataagtgaatttcttgtcagatcctcaaattatcttattatatatttatgagtattccaaaatccaaaaaagaaaaatccgaaatccaaaacacttttggtccccagcattttggataagggattctttccctgtaatagacacatagacggactgggaaaaagtaaaccaaaatgttaataacaagagttacttctggaaagtaggcctgcaggtgatttttattatctactctatttactgatgtattttccaaaatttctgtaatgaaaattatttttagaactagtaaaatccataaaagaaggcagtgatatagtaaagaagcactctcagctgggtgcagtggtcgtaaactttcttaaaaccttatgaaattgttttgcgatttttttttagctcatgagctatttttagtgtttgtgtattttatgtgtagtccaagacaattcttcttccaatgtggcccagggaagccaagagattggacacccctgcactatatttactgaatgtgtttgtgaaggctgtgcatctgaatgtcagacttgctaatgaaaaattaaatggagtccatgttttgggtacggccctaggccaaccacccacagccatgtaaggcatttaaaatacattgatttctcccttgagttcaggagttggagactgcaatgagctatgatggcaccactacactccaccctgggtgacagagcaagaccctgtctctcttaaaaacaac

SEQ ID NO: 286812 - DNA, 743 bp, Homo sapiens
gcgttgattctagggtcagggccctcactcacactgctggaaggttaaagtcgacttcacgctagtttaaggaaatatctgacgctgataaccatgtcccaagcactgctctaagttcccaatgtgtccggaattggtgggttcttggtctcactgacttcaagaatgaagccacggaccctcgcgttttagactatgctaaaaacagcctcaggaccttcagcactgatcaacaatcctgggcatgggctgaccgacagttttcacccagagagtgaagatcatggaggagccatcttaaattccgcccagcgcaggctcccaggaatcctaatgtcacgatctcactgcagccaatgtgacaaacacagcagtaattaagtctagagagctaaacacacctcaaaaagaattgtctcttggtatgagtggaatggaataaaatacatggaaacccaaaaaaaaaaaaaaaaaaaaaaaaactttgggggcggccctggagcccctggaaaaaaagttttccgagaacaaatcggtgtgggggggcggcggggccccaagtgggttcacgtggcaccggggccagaccgggctcccaagagaaccggtgcgcatgcaacaggggcgcggtgtcccccccatataaaaaaggccgcggggaacagcaggggttcggacacaattccgagaggggtcgaggccagaggatcctacagagggccccaggagacgaattaagccgg

SEQ ID NO: 286813 - DNA, 2022 bp, Homo sapiens
ctggcagttggcgcccatggagccagagctgctggttcggaaggtgtctgcattgcaggcctgcgtccggggcttcttggtccgacgccagttccagagcctgcgagctgagtatgaggcgattgtacgagaggtcgagggcgacctgggcacgcttcagtggaccgagggccgcattcccaggccgcgattcctcccagagaaggcaaaatcccatcagacctggaaagcaggagacagggtagcaaatccagagcaggggctgtggaaccacttcccatgtgaagagtctgagggagaggccacctgggaggagatggtgctgaagaagtcaggagagagctcagcaaatcaaggaagcctctgcagagatcacagctcctggcttcagatgaagcagaacaggaaacccagccaagagaagaccagagacacgacaaggatggagaatccagaagccacagatcaaagactgccccacagccaacctcagcttcaagagcttcagtaccaccgcagccacttggccatggaattgctgtggctgcaacaggccatcaatagccgtaaggagtacctacttcttaaacaaacactgagatccccagaggcgggcccgatcagagaggaaccccgcgtgttcctagaacatggggaacaggcctgtgagagggaccagtcacaaccaagcgcaccactggaggaccagtcctacagagacaggaccactggagagctagaacaggaggatgactcctgtcacagggtcaaatcaccccacagatccccaggaagtttggccactacacaaaaaaacattgctggggctaagtgcagagaaccatgctacagcaagtctggaccaccgtcgtctataccatcaaacagccaggccttgggggacaggctcaccaaagggccagacgatggaagacagacctttggagggacctgcctgctgcagatgaaaatcctggaggaccagacccccagaggtttaaaacctaggaaccattgtcccaggaagtccaggacacagctgtctgcactctatgaggactcaaatattaaggagatgtctcccagaaaactagaccacaaagagcctgactgccgaacagtcaggacacaagagttgggcctctcagaggaccacatcatctgggatggtaccttgggggggccagagcatagtgtcctcgatctctggaggactaaaccacccaaaggccaggcccccactgatagaagctccagagatggaacctccaatgagcctagtcatgaaggacagaaaaagcagaggactataccatggagatcaaagtcacctgagattctgtcttctacaaaggcaggctgtacaggagaggaacagtggaggggcaggccatggaaaacagaaccacctggctagaccctaggaagccaggagaggatcaggttccaaaggggaatgctatgaaagggcagtgagacaagacctcatcctacctccctgaccagctctggcttctgctcctgcccctggccattggtgactagtggggccaagagaagctggagcagagagctggcatgagtatagggaaggaggaaggacacattttcaatcctctgcctgtagctcaatccaaatttgtggataaggggccgggtgcagtggctcacacctgtaatcccagcactttgggaggccaaggtgagtggatcacctgaggtcagaagtttgagaccagcctgaccaacatggtgaaatgaaaccccatctcaactaaaaatataaaaattagccaggcgtggtggtgcatgcctgtagtcccagttactcgggaggctgagacaggagaatcgcttgaacccaggagatggagattgcagtaggccaagatgatgccactgcactccagcctgggctacagagcgagacacggtctcaaaaaacaaatgtgtggctaaggagttacctgggggaagtagaatgagaggtctgttgggaataaaggtttttcttagattctg

SEQ ID NO: 286814 - DNA, 1993 bp, Homo sapiens
ctggcagttggcgcccatggagccagagctgctggttcggaaggtgtctgcattgcaggcctgcgtccggggcttcttggtccgacgccagttccagagcctgcgagctgagtatgaggcgattgtacgagaggtcgaggggccgcattcccaggccgcgattcctcccagagaaggcaaaatcccatcagacctggaaagcaggagacagggtagcaaatccagagcaggggctgtggaaccacttcccatgtgaagagtctgagggagaggccacctgggaggagatggtgctgaagaagtcaggagagagctcagcaaatcaaggaagcctctgcagagatcacagctcctggcttcagatgaagcagaacaggaaacccagccaagagaagaccagagacacgacaaggatggagaatccagaagccacagatcaaagactgccccacagccaacctcagcttcaagagcttcagtaccaccgcagccacttggccatggaattgctgtggctgcaacaggccatcaatagccgtaaggagtacctacttcttaaacaaacactgagatccccagaggcgggcccgatcagagaggaaccccgcgtgttcctagaacatggggaacaggcctgtgagagggaccagtcacaaccaagcgcaccactggaggaccagtcctacagagacaggaccactggagagctagaacaggaggatgactcctgtcacagggtcaaatcaccccacagatccccaggaagtttggccactacacaaaaaaacattgctggggctaagtgcagagaaccatgctacagcaagtctggaccaccgtcgtctataccatcaaacagccaggccttgggggacaggctcaccaaagggccagacgatggaagacagacctttggagggacctgcctgctgcagatgaaaatcctggaggaccagacccccagaggtttaaaacctaggaaccattgtcccaggaagtccaggacacagctgtctgcactctatgaggactcaaatattaaggagatgtctcccagaaaactagaccacaaagagcctgactgccgaacagtcaggacacaagagttgggcctctcagaggaccacatcatctgggatggtaccttgggggggccagagcatagtgtcctcgatctctggaggactaaaccacccaaaggccaggcccccactgatagaagctccagagatggaacctccaatgagcctagtcatgaaggacagaaaaagcagaggactataccatggagatcaaagtcacctgagattctgtcttctacaaaggcaggctgtacaggagaggaacagtggaggggcaggccatggaaaacagaaccacctggctagaccctaggaagccaggagaggatcaggttccaaaggggaatgctatgaaagggcagtgagacaagacctcatcctacctccctgaccagctctggcttctgctcctgcccctggccattggtgactagtggggccaagagaagctggagcagagagctggcatgagtatagggaaggaggaaggacacattttcaatcctctgcctgtagctcaatccaaatttgtggataaggggccgggtgcagtggctcacacctgtaatcccagcactttgggaggccaaggtgagtggatcacctgaggtcagaagtttgagaccagcctgaccaacatggtgaaatgaaaccccatctcaactaaaaatataaaaattagccaggcgtggtggtgcatgcctgtagtcccagttactcgggaggctgagacaggagaatcgcttgaacccaggagatggagattgcagtaggccaagatgatgccactgcactccagcctgggctacagagcgagacacggtctcaaaaaacaaatgtgtggctaaggagttacctgggggaagtagaatgagaggtctgttgggaataaaggtttttcttagattctg

SEQ ID NO: 286815 - DNA, 2427 bp, Homo sapiens
  misc_feature (1902)..(1902): n is a, c, g, or t
ccctaaatcaacacatattcctaggatgtgggaacatatgcaatacttaaatgcacaggctctgggttcagactccctagggttaaattctccctgtgccggctagctgcatgattagatttgtgatcttgacaaagttacctaacgtctctgggcctcacttttctcatctgcaaaatagggaaaatagcaacacttctccataggggtgtggtgaggataaagagtagatgtaaataaagtgttgaatgtagagcctggcacatatcaagctcttaaaaagcaatggccattttgttatttttaccgcaacgacaactgcagttattatctggcttcagagctctctttttaaaaacagtattccctggttttacacccaggtgctaatactattctatgaagctaatgtatagagaccatatctttttaacaaacgtgtatatatgagtcatttccggcacatttgatacacatcatctcgtttggtccttaaaacaagcctaggccataagcagggtacgtgttaccactttgccattcctgttttacagaggcttagacacattgagaagcttttccatagtcacttaacaagtgatgggtgaagccaaatcaagcctttagatctccaagctctttccattaaaccatataaatcacgggttggcaaactttttctgcaaaggggacagatagtaaatagtttaagccttatgggccacatgctgtgtctgtttcatattctgctccttttttatttttattttttttaagaaaagacaccctttaaacatataaaaaccattctgagcaacaggctggtgctaaaaacaggtcatggtaaccattggctctagggttgtagtttactgttgatatagattgtacactgataagccaaaatacaaacctaatgaaactgacatacttaaggaactttactctttgttagcaatcattgttaatatttattgaatggtgactacgtgggaaatgctgttccaagtgtgatagatatattaacttacttaatcctcacacccactctaatttcctaagtactattgtcagactcattttacagacaggaaaagcaaggcatagagaaggtaagtaacttttccgaggtcacatggctattaagtagcagagctgtgattcaaatataagcggtttggcaccagatcctgtgcacttaaccgcttgcatctcggttgggagcactgactggttcagctattgggagggaagaaaggggatggggaagccacataacccctaggagattctgtaataaatatgcttcagagccattcaccttgaagctgaggaggcatggaagcaggccacctgtgttctgtacagcatcaccaggctggaaatctgccatggctttccttcacgccatcacaagaggatacagatgaggctgcagaggcatcttgatttgagaaaagcatttgactggatctcattaaattttaatcattaactgaattcaaaataaattgaaaactggttgacagagcaccaacaaagggtgatgataaatggtgatgcatctagaggggagctatcttccaggggacaactctaaggcaaggacggatgggatttaatgaaggtgttatgtccccagaagaagacaaatagcacagcaaggaacagaggaaggacaggagtgagcagcctgagtaattaataaaccatattaacagctcctccataatcaggccttggtgatcacaactgcttggattttttcttaagctttctttgagtcaggaataggtttgaagcgtcctagagacacacagcatgaatatttcaggtggacattaaaaagaaatctataaatttacagctgggaggatcctgagatctacttcggatcagaanctttcaattacaagattcccaaggccttacttcattccccagagagtaatctttttaataaatgtccaaaagtcatggatttaaaaaaaaatctttaaactcattaatgtcctttgtttcctgcccaaatgcatgcaaactttcataacactggtttgctgagtggaaggttggttttgagtgaactgtttggctcagattcaaactccaatgaacaaatacttccaagtttacttgctgaatttcccatacagagaagttcttccactgggcttgccagaggatttgaaacagtggtgagccctggaaggaagggaatatttactggcccttggacataaacccagcacagtaagactcacatcaggctgaaggcagtgcagtatgaaccgacctgatttgaggaagtttgctctgggactcctctgagctactaaatgaggaggagaaggactaatgggaacacactgactccatcacattagaagttataataaacatttagagaacaacctcaaaaaagcc

SEQ ID NO: 286816 - DNA, 345 bp, Homo sapiens
tgacaaaggtggtatacctttctagccctgaaggagagggaatctcactcctgagctgggtttcaggagctaagcctagagggacccaacccactcttctgggcacctgagagtcacttgtagcaatttgatgccccatcagcactaatattcctcttattaagatctctgaccgggagccactgcgcccggcctccccaaggagcacttttacagccaaacccacctctctcagctctcactcctgcttatatccctgcaacccaggagactgttttctatttgtaaaattttgccatttcaagacagttgtattaatgaaatcactgtgtgtgtcaaaaaaaa

SEQ ID NO: 286817 - DNA, 585 bp, Homo sapiens
taaactttatttatgtacttattttgagatggggtcttgctgttttgcccaggctggtcttgaattcctgggcttaagccaaccttcctgtctcagcctccagagtagctgggattacaggcatgcagcaccatgcccagcttcaaaactaagattatttctacccaactggactgctttaagagccatgttttcaatgattcaaccttatttttacatccactaatggcaaattctgaaagaataaaaacccaccctccagggcactggtgtgaatggagggccctttgtggaatcccttcctctaaaaaggcagttgaaggaaactgccagagccacagcagctgtatggaagggaaagctatcaggggagttcgtctttgatcattagacgggaaaaactcatcatcaatactacctttcccttccctactacttttctatattagctaaattccattttgaaaacaaagtatttccaaaatatcaatcttggcctaaggtcaaatagaaacataatacatttttttcttctggggtggggaaaaaagtgaaattttactataataaacccaagcataaagc

SEQ ID NO: 286818 - DNA, 567 bp, Homo sapiens
gtgaaagccaccgttgcccggggatgggtccctgacacttggcgaagtaggagccctgtgtgatcgtgcgtctgagtctgggctgagaccagtcctggccagggcagttaccaggacggtctccggaggccgggattcgcggagggtccagcagcaggaagaaaccccaggaggaagaaacctcagacagatcgccggcgaggcagcgcgggatcccagcctcaggcgtgcgcggacggtgtgcggcgcacacaaccaagcttaggagccgactgttaagatgccccagtgacacggacaagtttctcctctgcaacccaatgagagctgctgaccacgagagcatcgcgggaccgccaaaggattctggaaaatgtggtcccgggtggccagtgtgcgctgaccttcacctgaaggtacggcttgaaggaaacttctggagggtggggtggtgttgaagagaaggcacaattgtcaccattttgttcaacatgggcgttttctttgtgcattgatttgcatttttaaaggtattccattaaaaatatgtttatctattttaaaaaa

SEQ ID NO: 286819 - DNA, 601 bp, Homo sapiens
gactcacagactgcagatgcacgctgcggatccagaagccggtcaggtaatgaggtgcagaggtgtggggaagacctgggtgcttccctgggtgccaaccagcctaaccagccggggccaccaaacagaagtgcttctgacattaacgcgacacacagaaggtgtgtagggtgggtagtggaagtgaccgcagaggcctctggggattgtagttttggagctagagaggcgggcaagcagttggcttcgcccacacggtgtgcctctcacatctgcacagcgcacacaaccaagcttaggagccgactgttaagatgccccagtgacacggacaagtttctcctctgcaacccaatgagagctgctgaccacgagagcatcgcgggaccgccaaaggattctggaaaatgtggtcccgggtggccagtgtgcgctgaccttcacctgaaggtacggcttgaaggaaacttctggagggtggggtggtgttgaagagaaggcacaattgtcaccattttgttcaacatgggcgttttctttgtgcattgatttgcatttttaaaggtattccattaaaaatatgtttatctattttaaaaaa

SEQ ID NO: 286820 - DNA, 935 bp, Homo sapiens
cgccgccgccgccgccgcaacctccagcaccgccgccccaggccccgcagccgccgcgtcgccgccattttttaaagggtccgcagcctgactctgcggagtaagggggggtggagcgggggagtcggcctcgccagcgcgcatgcgcgaggcccgagccgccgcttgggccacagtgaaagccaccgttgcccggggatgggtccctgacacttggggaagtaggagccctgtgtgatcgtgcgtctgagtctgggctgagaccagtcctggccagggcagttaccaggacggtctccggaggccgggattcgcggagggtccagcagcaggaagaaaccccaggaggaagaaacctcagacagatcgccggcgaggcagcgcgggatcccagcctcaggcgtgcgcggacggtgtgcgggtgagtctccccaaaagtggagcccttgtgatgacgagcacaggtccgcctgtgtgcccgtgggctgctctctcaccggtggctcgtagtcgcgtaaagcagaagtagcagtttcagcggctgacactaagaacaatgcatactggcaaagtgaggtgtctcacatttttaatcccagcaatttgggaggctgaggcggatggatcacttgaggtcaggggatcacaccagcctaaccaacatgatgaaactccgcgtctactaaaaaaaagtaccagacatttagcgcggtgtggtggcatatgcctgtaaatcccagctatttgggaggctgaggcaggagaatcggttgaaccagtgtggccgaggttgcagtgagtgtagattgcaccactgcactctagcctgggtaacaagcacaaaactctgtctcaaaaaaaaaaaaaaattatcagtgcagagttaggccagattcattttcagagtaggagggaatttcaaattatgggtgaaa

SEQ ID NO: 286821 - DNA, 397 bp, Homo sapiens
gtgaaagccaccgttgcccggggatgggtccctgacacttggcgaagtaggagccctgtgtgatcgtgcgtctgagtctgggctgagaccagtcctggccagggcagttaccaggacggtctccggaggccgggattcgcggagggtccagcagcaggaagaaaccccaggaggaagaaacctcagacagatcgccggcgaggcagcgcgggatcccagcctcaggcgtgcgcggacggtgtgcgggtacggcttgaaggaaacttctggagggtggggtggtgttgaagagaaggcacaattgtcaccattttgttcaacatgggcgttttctttgtgcattgatttgcatttttaaaggtattccattaaaaatatgtttatctattttaaaaaa

SEQ ID NO: 286822 - DNA, 1024 bp, Homo sapiens
tttttttttaaagagatgggatcttgctttgttacccaagctggtcttgaactcctggcctgaagcagtcccgctgccttggccttctaaagcactgggattacatatgttagccattgcacccagccagcttttaaaaaaaacattacagccttaggattttgccttcctattggctttttagatcaatcagaatacttacttcccagccatagttttaaggctgtctcatggtgttaaatccatcatactgttttgttaactttcattcaaatcacccaaaagttattaggccttgggcttaagaaatggacaattggttaatagtttgatttccgcccgcccccccgccccgccctccacaggttttctttaggaatttctcataactatttattgtatccataaggattgcaaggtctcttggatcaggttgtcaccaggctggagtgcattggtacagtcacggttcactgcagcctccacctcctgggctcaagggatcctcctatctcagcctcccaagtagctgggtctacaggtatactctaccaccccagcttaatcatttttaatattgcgttttcttgggggtaagggaaataaggagttaaatgtaaaacagttttacttataaaaggctaagaatatttggtaagaacttggaataatcaaggaagcaaaacaaagtagattttataattttgctggatagttttttttgttttttgtttttttttcttttttggagatggagtctcactctgtcacccaggctggagtacagtggtgtgatcttggcttactgcaggctccacctcctgggttcaagcaattctcctgcctcagcctcccaagtagctgggattacaggtgtgcaccaccacacctggctaattttttatctttttagtagagacggggtttcgccacgttggccaggctggtcttgaactcctgacctcaggtgatccaccctcctcagcctcccaaattgctgggattacaggcatgagccactgcg

SEQ ID NO: 286823 - DNA, 621 bp, Homo sapiens
tttttttttaaagagatgggatcttgctttgttacccaagctggtcttgaactcctggcctgaagcagtcccgctgccttggccttctaaagcactgggattacatatgttagccattgcacccagccagcttttaaaaaaaacattacagccttaggattttgccttcctattggctttttagatcaatcagaatacttacttcccagccatagttttaaggctgtctcatggtgttaaatccatcatactgttttgttaactttcattcaaatcacccaaaagttattaggccttgggcttaagaaatggacaattggttaatagtttgatttccgcccgcccccccgccccgccctccacaggttttctttaggaatttctcataactatttattgtatccataaggattgcaaggtctcttggatcaggtaagacctttagattgcctcttctttaaaggaggctttcttgaatacctttccctgaggttggataggcactgctccccttctctgtgcccctggctcccacatctaatgttctcctggcacttacgacactctcattcaaattttctagccatgcaccttaagccccagccccacacctgggaaaca

SEQ ID NO: 286824 - DNA, 1989 bp, Homo sapiens
  misc_feature (1619)..(1620): n is a, c, g, or t
cacctggagggaaaacaacacacattgcagcactaatgcatgatcagggagaagttatagcactggataaaatcttcaacaaagtagaaaaaatcaaacagaatgccttattgttagggctgaattccatcagggcattttgttttgatggaacaaaggcggttaaacttgatatggtggaggacacagaaggagaacctccatttctaccagaatcctttgaccgaattcttctggatgcaccctgtagtggaatgggacagagaccaaacatggcctgtacttggtctgtgaaggaagtggcatcatatcagccattacagcgaaaactcttcactgcagcggttcagctgctgaagccagagggtgtgctggtttatagcacgtgcactataacactggccgaaaatgaagaacaggttgcctgggccctgacaaaatttccttgccttcagcttcagccccaggaaccgcagattggaggagaaggaatgaggggagctgggctctcatgtgaacagttgaaacagctgcagcgatttgatccatcggctgtgccattaccggacactgacatggactctcttagagaggccagaagagaagacatgttgcgtctggctaataaggactctataggtttttttattgcaaaatttgtaaaatgcaaaagcacataggagagggatggatgctcagaaatgaaaattccaaacatttgctgtctgtggtttttttttttttaaccaaagtgttgtcaggccaactgaatgatgatgtggttgctatggaaacagaaaaggctgccagctgttttaccagggatccagagacatagaggaagtagggggtggtatgagattatattttctgtttttaaaagattttttttttttatgtatttagtagagtataaagaaaagcagatgcctatagatgtctggagcatattttcatttgtgatctaatgttttaatttgtaaagtgtacaagtcatttttaatgttaaaaattagtgaatctaacaaaaggaataaattagcaatatttgatgtggttatgaaaagttgtttttgtttctaggttcctagtttcttaaggattcagggcatgggaagtaaaacattgactatgtgccaataatggaggttgtcaccaggctggagtgcattggtacagtcacggttcactgcagcctccacctcctgggctcaagggatcctcctatctcagcctcccaagtagctgggtctacagaacagaaactttggttataagaagcacttctgggttctgacagacagtgaacctgctggagtcggtggtggggaggaatggttcttcttcagcttgggaagcagaacggataggagcggagcgatcagtcctctgatcaccttgagaaccctggcagcgaaaggagcacaccaggcgttaaccaagactatggaaatgatgtcagacaaaaagcgaatttgagtgactttcttattcgagttcaaaatgggtcgtaaagcagtggagacaacttgcaatatcaacaatgcatttggcccaggaactgctaatgaacgtacagtgcggtggtggttcacgaagctttgcaaaggagacgaggnncttgaagatgaggagcatagtggctgaccattggaagttgacagcgactactcaagaacaataatcaaagctgattctcttacaactacacgagaagttgctgaagaattcaacattgaccattctatggtctttctacatttgaagcaaatcggaaaggtgaaaaaactcaataagtaggtgcctcatgagccaagcaaaaataaattgttgtttggaagcatcttctcttattctgtgcaacaacaatgaaccatttctcagtcggattgtgacgtgggacgaaaattggattttatatgacaaccactgacaaccagctcagctgttggactgagaagctccaaagccaaacttgcaccaaaaaaa

SEQ ID NO: 286825 - DNA, 1738 bp, Homo sapiens
  misc_feature (32)..(32): n is a, c, g, or t
  misc_feature (1368)..(1369): n is a, c, g, or t
cagagaagattagcatggcccctgcgcaaggntgacacgcaaattcgtgaagcgttccatatttttttacagcgaaaactcttcactgcagcggttcagctgctgaagccagagggtgtgctggtttatagcacgtgcactataacactggccgaaaatgaagaacaggttgcctgggccctgacaaaatttccttgccttcagcttcagccccaggaaccgcagattggaggagaaggaatgaggggagctgggctctcatgtgaacagttgaaacagctgcagcgatttgatccatcggctgtgccattaccggacactgacatggactctcttagagaggccagaagagaagacatgttgcgtctggctaataaggactctataggtttttttattgcaaaatttgtaaaatgcaaaagcacataggagagggatggatgctcagaaatgaaaattccaaacatttgctgtctgtggtttttttttttttaaccaaagtgttgtcaggccaactgaatgatgatgtggttgctatggaaacagaaaaggctgccagctgttttaccagggatccagagacatagaggaagtagggggtggtatgagattatattttctgtttttaaaagattttttttttttatgtatttagtagagtataaagaaaagcagatgcctatagatgtctggagcatattttcatttgtgatctaatgttttaatttgtaaagtgtacaagtcatttttaatgttaaaaattagtgaatctaacaaaaggaataaattagcaatatttgatgtggttatgaaaagttgtttttgtttctaggttcctagtttcttaaggattcagggcatgggaagtaaaacattgactatgtgccaataatggaggttgtcaccaggctggagtgcattggtacagtcacggttcactgcagcctccacctcctgggctcaagggatcctcctatctcagcctcccaagtagctgggtctacagaacagaaactttggttataagaagcacttctgggttctgacagacagtgaacctgctggagtcggtggtggggaggaatggttcttcttcagcttgggaagcagaacggataggagcggagcgatcagtcctctgatcaccttgagaaccctggcagcgaaaggagcacaccaggcgttaaccaagactatggaaatgatgtcagacaaaaagcgaatttgagtgactttcttattcgagttcaaaatgggtcgtaaagcagtggagacaacttgcaatatcaacaatgcatttggcccaggaactgctaatgaacgtacagtgcggtggtggttcacgaagctttgcaaaggagacgaggnncttgaagatgaggagcatagtggctgaccattggaagttgacagcgactactcaagaacaataatcaaagctgattctcttacaactacacgagaagttgctgaagaattcaacattgaccattctatggtctttctacatttgaagcaaatcggaaaggtgaaaaaactcaataagtaggtgcctcatgagccaagcaaaaataaattgttgtttggaagcatcttctcttattctgtgcaacaacaatgaaccatttctcagtcggattgtgacgtgggacgaaaattggattttatatgacaaccactgacaaccagctcagctgttggactgagaagctccaaagccaaacttgcaccaaaaaaa

SEQ ID NO: 286826 - DNA, 2094 bp, Homo sapiens
  misc_feature (1724)..(1725): n is a, c, g, or t
cacctggagggaaaacaacacacattgcagcactaatgcatgatcagggagaagttatagcactggataaaatcttcaacaaagtagaaaaaatcaaacagaatgccttattgttagggctgaattccatcagggcattttgttttgatggaacaaaggcggttaaacttgatatggtggaggacacagaaggagaacctccatttctaccagaatcctttgaccgaattcttctggatgcaccctgtagtggaatgggacagagaccaaacatggcctgtacttggtctgtgaaggaagtggcatcatatcagccattacagcgaaaactcttcactgcagtatgtggtggtctgtttttgtgaaacaaagttaacttttgctactttgatgtttaaactactgacagcaatctccatagcagcgttcattacaatagccaaaaggcggttcagctgctgaagccagagggtgtgctggtttatagcacgtgcactataacactggccgaaaatgaagaacaggttgcctgggccctgacaaaatttccttgccttcagcttcagccccaggaaccgcagattggaggagaaggaatgaggggagctgggctctcatgtgaacagttgaaacagctgcagcgatttgatccatcggctgtgccattaccggacactgacatggactctcttagagaggccagaagagaagacatgttgcgtctggctaataaggactctataggtttttttattgcaaaatttgtaaaatgcaaaagcacataggagagggatggatgctcagaaatgaaaattccaaacatttgctgtctgtggtttttttttttttaaccaaagtgttgtcaggccaactgaatgatgatgtggttgctatggaaacagaaaaggctgccagctgttttaccagggatccagagacatagaggaagtagggggtggtatgagattatattttctgtttttaaaagattttttttttttatgtatttagtagagtataaagaaaagcagatgcctatagatgtctggagcatattttcatttgtgatctaatgttttaatttgtaaagtgtacaagtcatttttaatgttaaaaattagtgaatctaacaaaaggaataaattagcaatatttgatgtggttatgaaaagttgtttttgtttctaggttcctagtttcttaaggattcagggcatgggaagtaaaacattgactatgtgccaataatggaggttgtcaccaggctggagtgcattggtacagtcacggttcactgcagcctccacctcctgggctcaagggatcctcctatctcagcctcccaagtagctgggtctacagaacagaaactttggttataagaagcacttctgggttctgacagacagtgaacctgctggagtcggtggtggggaggaatggttcttcttcagcttgggaagcagaacggataggagcggagcgatcagtcctctgatcaccttgagaaccctggcagcgaaaggagcacaccaggcgttaaccaagactatggaaatgatgtcagacaaaaagcgaatttgagtgactttcttattcgagttcaaaatgggtcgtaaagcagtggagacaacttgcaatatcaacaatgcatttggcccaggaactgctaatgaacgtacagtgcggtggtggttcacgaagctttgcaaaggagacgaggnncttgaagatgaggagcatagtggctgaccattggaagttgacagcgactactcaagaacaataatcaaagctgattctcttacaactacacgagaagttgctgaagaattcaacattgaccattctatggtctttctacatttgaagcaaatcggaaaggtgaaaaaactcaataagtaggtgcctcatgagccaagcaaaaataaattgttgtttggaagcatcttctcttattctgtgcaacaacaatgaaccatttctcagtcggattgtgacgtgggacgaaaattggattttatatgacaaccactgacaaccagctcagctgttggactgagaagctccaaagccaaacttgcaccaaaaaaa

SEQ ID NO: 286827 - DNA, 1406 bp, Homo sapiens
cacctggagggaaaacaacacacattgcagcactaatgcatgatcagggagaagttatagcactggataaaatcttcaacaaagtagaaaaaatcaaacagaatgccttattgttagggctgaattccatcagggcattttgttttgatggaacaaaggcggttaaacttgatatggtggaggacacagaaggagaacctccatttctaccagaatcctttgaccgaattcttctggatgcaccctgtagtggaatgggacagagaccaaacatggcctgtacttggtctgtgaaggaagtggcatcatatcagccattacagcgaaaactcttcactgcagcggttcagctgctgaagccagagggtgtgctggtttatagcacgtgcactataacactggccgaaaatgaagaacaggttgcctgggccctgacaaaatttccttgccttcagcttcagccccaggaaccgcagattggaggagaaggaatgaggggagctgggctctcatgtgaacagttgaaacagctgcagcgatttgatccatcggctgtgccattaccggacactgacatggactctcttagagaggccagaagagaagacatgttgcgtctggctaataaggactctataggtttttttattgcaaaatttgtaaaatgcaaaagcacataggagagggatggatgctcagaaatgaaaattccaaacatttgctgtctgtggtttttttttttttaaccaaagtgttgtcaggccaactgaatgatgatgtggttgctatggaaacagaaaaggctgccagctgttttaccagggatccagagacatagaggaagtagggggtggtatgagattatattttctgtttttaaaagattttttttttttatgtatttagtagagtataaagaaaagcagatgcctatagatgtctggagcatattttcatttgtgatctaatgttttaatttgtaaagtgtacaagtcatttttaatgttaaaaattagtgaatctaacaaaaggaataaattagcaatatttgatgtggttatgaaaagttgtttttgtttctaggttcctagtttcttaaggattcagggcatgggaagtaaaacattgactatgtgccaataatggaggtaagtattttacctgactctctgtctgcttatttagtaagtcaaccccctttcaaatgaagtctggacctcctctgaatgatagtgtgaagtgatagtctaaagactatcgtagtctaaatggtagtctatgttcaatgtttttcataattttaaacgaaaaagtaaagttagtattttctttactttgtagatttagaaaatgagattattctacaatttggataacttatcatgtatttgaaacatatcagttat

SEQ ID NO: 286828 - DNA, 284 bp, Homo sapiens
gagaagttatagcactggataaaatcttcaacaaagtagaaaaaatcaaacagaatgccttattgttagggctgaattccatcagggcattttgttttgatggaacaaaggcggttaaacttgatatggtggaggacacagaaggtgagctattttgattttcttatttttaattgacagatcatatatttgtggcatacagtgtgatgttttgacatgtatataattttgtatacaatgtggaatgattaaaacaagctaattaacatatccatcactgtact

SEQ ID NO: 286829 - DNA, 781 bp, Homo sapiens
cggtggcccctcccgcccacgcgccagagtcgcagtgggcgggcctacgtgctccgcccgctgtgagcctgtccggcccccgcccgctccggagcaacccgcgagcttacaccggcttctctctgtcctcagcccgcgcgccgccatcgccgtcatgctgggcgccgctctccgccgctgcgctgtggccgcaaccacccgggccgaccctcgaggcctcctgcactccgcccggacccccggccccgccgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactg

SEQ ID NO: 286830 - DNA, 947 bp, Homo sapiens
  misc_feature (784)..(784): n is a, c, g, or t
  misc_feature (786)..(786): n is a, c, g, or t
  misc_feature (790)..(790): n is a, c, g, or t
cggtggcccctcccgcccacgcgccagagtcgcagtgggcgggcctacgtgctccgcccgctgtgagcctgtccggcccccgcccgctccggagcaacccgcgagcttacaccggcttctctctgtcctcagcccgcgcgccgccatcgccgtcatgctgggcgccgctctccgccgctgcgctgtggccgcaaccacccgggccgaccctcgaggcctcctgcactccgcccggacccccggccccgccgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactggcncncacnccccccaccccccaacacacaacacggcggacctaatagaaagacaccataagggggccccaatttacgtctacccgaatattacttacaatctggccccttctgcggaacatatacacccagctagtgcctcccttcaacccttacacggaaaacg

SEQ ID NO: 286831 - DNA, 701 bp, Homo sapiens
ggacgcgtgggtcgacccacgcgtcgcgccgtcatgctgggcgccgctctccgccgctgcgctgtggccgcaaccacccgggccgaccctcgaggcctcctgcactccgcccggacccccggccccgccgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaaaaaaaaaaaaaacaagcaacccaaaaaaaaaacttcgc

SEQ ID NO: 286832 - DNA, 640 bp, Homo sapiens
  misc_feature (20)..(20): n is a, c, g, or t
gagagagagagagagctcgnccggacccccggccccgccgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgtacgcgtacaaggccccgcagccaccattctgctttctgtctctctggttttgactattctcagtatctcatataagtggaatcatacagtgacttgtctttttgtgactggcttatttcacttagcataatgtcctccaggttcatccatgtcgtgtcaggtgacaggattccttcctgtattatcattttatggatgttccgttctgtgcgtacccactctgtctcctcgtgaacctggttgtcctctgacta

SEQ ID NO: 286833 - DNA, 663 bp, Homo sapiens
cggtggcccctcccgcccacgcgccagagtcgcagtgggcgggcctacgtgctccgcccgctgtgagcctgtccggcccccgcccgctccggagcaacccgcgagcttacaccggcttctctctgtcctcagcccgcgcgccgccatcgccgtcatgctgggcgccgctctccgccgctgcgctgtggccgcaaccacccgggccgaccctcgaggcctcctgcactccgcccggacccccggccccgccgtgggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactg

SEQ ID NO: 286834 - DNA, 822 bp, Homo sapiens
cggtggcccctcccgcccacgcgccagagtcgcagtgggcgggcctacgtgctccgcccgctgtgagcctgtccggcccccgcccgctccggagcaacccgcgagcttacaccggcttctctctgtcctcagcccgcgcgccgccatcgccgtcatgctgggcgccgctctccgccgctgcgctgtggccgcaaccacccgggccgaccctcgaggcctcctgcactccgcccggacccccggccccgccgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaaaaaaaaaaaaaacaagcaacccaaaaaaaaaacttcgc

SEQ ID NO: 286835 - DNA, 570 bp, Homo sapiens
  misc_feature (20)..(20): n is a, c, g, or t
gagagagagagagagctcgnccggacccccggccccgccgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactg

SEQ ID NO: 286836 - DNA, 678 bp, Homo sapiens
cggtggcccctcccgcccacgcgccagagtcgcagtgggcgggcctacgtgctccgcccgctgtgagcctgtccggcccccgcccgctccggagcaacccgcgagcttacaccggcttctctctgtcctcagcccgcgcgccgccatcgccgtcatgctgggcgccgctctccgccgctgcgctgtggccgcaaccacccgggccgaccctcgaggcctcctgcactccgcccggacccccggccccgccgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaagacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactg

SEQ ID NO: 286837 - DNA, 508 bp, Homo sapiens
cggtggcccctcccgcccacgcgccagagtcgcagtgggcgggcctacgtgctccgcccgctgtgagcctgtccggcccccgcccgctccggagcaacccgcgagcttacaccggcttctctctgtcctcagcccgcgcgccgccatcgccgtcatgctgggcgccgctctccgccgctgcgctgtggccgcaaccacccgggccgaccctcgaggcctcctgcactccgcccggacccccggccccgccgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtcgggggaacggtggggggttccatgacggtcgggggtcccat

SEQ ID NO: 286838 - DNA, 893 bp, Homo sapiens
  misc_feature (730)..(730): n is a, c, g, or t
  misc_feature (732)..(732): n is a, c, g, or t
  misc_feature (736)..(736): n is a, c, g, or t
cggtggcccctcccgcccacgcgccagagtcgcagtgggcgggcctacgtgctccgcccgctgtgagcctgtccggcccccgcccgctccggagcaacccgcgagcttacaccggcttctctctgtcctcagcccgcgcgccgccatcgccgtcatgctgggcgccgctctccgccgctgcgctgtggccgcaaccacccgggccgaccctcgaggcctcctgcactccgcccggacccccggccccgccgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactggcncncacnccccccaccccccaacacacaacacggcggacctaatagaaagacaccataagggggccccaatttacgtctacccgaatattacttacaatctggccccttctgcggaacatatacacccagctagtgcctcccttcaacccttacacggaaaacg

SEQ ID NO: 286839 - DNA, 1083 bp, Homo sapiens
acgcgtgggcggacgcgtggggactggattatggacagaacttggaaatattgagaataatttcttaaagccacttcatataggacttaatatgtcaaaagcacattatgaagcagaaattaaaaatagccaagaggcccagaaatctaaagatctttgttctataactgtaagtggagaagagatccctaatatgcctcctgaaatgcagcttaaggtcctgcattcagctcttttcacatttgatttgattgaaagtgttctagctcgagtggaagaactcattgaaataaaaacaaagtctacctctgaagaaaatattgggataaagtgaaagttccatttcctaaataaaaactaataaaatatagtactttccattatgattcatttaatacctttataaaaaatttttctgtaaaaatttactgcttgaaaaataaatgtagcttttctcatttatcaatttctataatgatacactatagaacaggtttttttggttttaaagttatctaatggtaaataatgcccacatatgtcctaaatactacttttgaaaatccaatacaaactaataattttataacttcataaaatgtagctgaattgtctatattcattcctacagttttagtgagcttataaaaatactgatacactttctgctgcagttagatgctatgtaacatttcggaactcctagtgtcaagttggctatcataccagtgtaaagaggccagttgacttttcttagcttctcttttcctggctcaggtggagtctttgggagcagagtcccatcaccacctctccagcagaagttataataggaaaacatctgcaaagattaattttagaaatacttgctacctttatggaaaaaaactaaaaaatatatatgactttaagaaactgattagaaaattctgtatttttatttcctactaaagatttgtccatttaactcactaagaagctacacctgagttttatggtatatgtatgtatcagtcctttgctaaagagcgttaaatcttgcagcgaaactcctaaaataaaatcacttttaattgtaaatgt

SEQ ID NO: 286840 - DNA, 788 bp, Homo sapiens
tttccatcagtaggaaagggaaagcatcctctagaactagatccgtggtgtggatatcaattgaaaggccatacttgggatgaaggcataaataaggtagagtcattgtggagatggctcatagaggaagagacgtctgtgaatttatcctcaaataattttctcataaataaaacttaacaagttaatagatctcaaaacctggagctatccaaatggtgcagtgataagcgtagtgccccaagtacatttttcttttaattggtattcacataactagctatagtaataattattaaatagtgaagtccattgtgaaaagcaagggccatgtttcatttatttttgttttttgagcttttatcgcgtttaatagtaggcaatcaatcattgttgaactaaataactcattctttcattcttaacagactgactggattatggacagaacttggaaatattgagaataatttcttaaagccacttcatataggacttaatatgtcaaaagcacattatgaagcagaaattaaaaatagccaagaggcccagaaatctaaagatctttgttctataactgtaagtggagaagagatccctaatatgcctcctgaaatgcagcttaaggtcctgcattcagctcttttcacatttgatttgattgaaagtgttctagctcgagtggaagaactcattgaaataaaaacaaagtctacctctgaagaaaatattgggataaagtgaaagttccatttcctaaataaaaactaataaaatatagtactttc

SEQ ID NO: 286841 - DNA, 1661 bp, Homo sapiens
atttaaaagaatttccattacaaagtaaaactgaaaggatgaaagaaaaaaattttcaacttagaacttctacaagaggaaagtttttcatggatacaaattctttggttatatttttgcaaatattccagtctgtggcttgtgttttaatagtatttttcaaagaacagaaattttaatatttatggagtccaacttatcaattttattcttttatgattcattatttatgggttctaagaagtctttgttaacccagatcacaaaggtaatttcttgtagaaattgtatagttttaggttttacacttaggtcaatgaccccatttcaagtaaactttttatgatatgagatatgggttgagagatttttttttcttttattttgacctcaacactatttgtagaaaaggttatccttaatttactgaattatcttggcaactttatcaaaaatcattttataagtatgggtctatttttggactctattccatttacctgtatctattcttttaccaataccacactgtcttgattcctttataggaagaaattattctgttttattcctttataggaagtcttgacctcaagtaatactggattatggacagaacttggaaatattgagaataatttcttaaagccacttcatataggacttaatatgtcaaaagcacattatgaagcagaaattaaaaatagccaagaggcccagaaatctaaagatctttgttctataactgtaagtggagaagagatccctaatatgcctcctgaaatgcagcttaaggtcctgcattcagctcttttcacatttgatttgattgaaagtgttctagctcgagtggaagaactcattgaaataaaaacaaagtctacctctgaagaaaatattgggataaagtgaaagttccatttcctaaataaaaactaataaaatatagtactttccattatgattcatttaatacctttataaaaaatttttctgtaaaaatttactgcttgaaaaataaatgtagcttttctcatttatcaatttctataatgatacactatagaacaggtttttttggttttaaagttatctaatggtaaataatgcccacatatgtcctaaatactacttttgaaaatccaatacaaactaataattttataacttcataaaatgtagctgaattgtctatattcattcctacagttttagtgagcttataaaaatactgatacactttctgctgcagttagatgctatgtaacatttcggaactcctagtgtcaagttggctatcataccagtgtaaagaggccagttgacttttcttagcttctcttttcctggctcaggtggagtctttgggagcagagtcccatcaccacctctccagcagaagttataataggaaaacatctgcaaagattaattttagaaatacttgctacctttatggaaaaaaactaaaaaatatatatgactttaagaaactgattagaaaattctgtatttttatttcctactaaagatttgtccatttaactcactaagaagctacacctgagttttatggtatatgtatgtatcagtcctttgctaaagagcgttaaatcttgcagcgaaactcctaaaataaaatcacttttaattgtaaatgt

SEQ ID NO: 286842 - DNA, 1923 bp, Homo sapiens
cagaagagcgggctaagacgccggaggaggtggcggcggctgggagaggcgagggttctggccgattttagcatcgaaactaggagaaataagaatggctgtagaggaacttcagtctataataaagagatgtcaaatcctagaagagcaagactttaaagaagaggattttggcctatttcagttagctgggcaaagatgcatagaagaagggcacacagaccagctattagaaattattcaaaatgaaaagaataaggtcatcatcaagaatatgggctggaatctcgttggtcctgttgttcgatgccttttgtgtaaagataaagaggatagtaaaagaaaagtttattttttgatctttgatttattggtaaagttatgcaatccaaaggaattattgttgggtttgcttgaactgattgaagagccctctggaaaacagatatcccaaagtattcttcttttgcttcagccattacaaacagtgattcagaaacttcataacaaggcatattcaattggattagcattgtctaccctttggaatcagctatctcttcttcctgttccatactcaaaagaacaaatacaaatggatgactatggcctttgtcagtgttgcaaggccttaatagagttcactaagccttttgtggaagaagtcattgataacaaagaaaactcactggaaaatgaaaagttaaaggatgaattactgaaattttgtttcaaaagcttgaaatgccctttgctgacagcacaattctttgaacagtctgaagaaggtggaaatgatcctttcaggtattttgcatcagaaataataggttttttatcagcaattggacaccctttccccaaaatgatttttaatcatggaaggaaaaagagaacttggaattaccttgaatttgaagaagaagaaaataaacagttagcagactcaatggcttctctggcatatctagtatttgtacagggcatccatattgatcagcttccaatggtcttaagcccattgtaccttttgcagtttaatatggggcacattgaagtctttttgcaaagaacagaagagtctgttatctccaaaggattggagctgctggagaatagtttattgagaatagaagacaatagtctactttaccagtacttagaaatcaagagttttcttactgtacctcagggcttagtgaaagtaatgacactttgccccattgagacactgaggaaaaagagtttagctatgcttcagctgtatattaacaagttggattcacaaggcaaatatacattatttaggtgcttattgaatacaagtaatcactcaggtgtggaggcttttattattcaaaatatcaaaaatcaaattgacatgtcattaaagagaacacgtaacaacaaatggtttacaggaccacagttgatttcccttcttgatttggtactttttctcccagagggtgcagaaacagatttactgcaaaactcagataggattatggcttcattaaatttattgaggtatttggttatcaaagataatgaaaatgacaatcaaactggattatggacagaacttggaaatattgagaataatttcttaaagccacttcatataggacttaatatgtcaaaagcacattatgaagcagaaattaaaaatagccaagaggcccagaaatctaaagatctttgttctataactgtaagtggagaagagatccctaatatgcctcctgaaatgcagcttaaggtcctgcattcagctcttttcacatttgatttgattgaaagtgttctagctcgagtggaagaactcattgaaataaaaacaaagtctacctctgaagaaaatattgggataaagtgaaagttccatttcctaaataaaaactaataaaatatagtactttc

SEQ ID NO: 286843 - DNA, 1838 bp, Homo sapiens
cagaagagcgggctaagacgccggaggaggtggcggcggctgggagaggcgagggttctggccgattttagcatcgaaactaggagaaataagaatggctgtagaggaacttcagtctataataaagagatgtcaaatcctagaagagcaagactttaaagaagaggattttggcctatttcagttagctgggcaaagatgcatagaagaagggcacacagaccagctattagaaattattcaaaatgaaaagaataaggtcatcatcaagaatatgggctggaatctcgttggtcctgttgttcgatgccttttgtgtaaagataaagaggatagtaaaagaaaagtttattttttgatctttgatttattggtaaagttatgcaatccaaaggaattattgttgggtttgcttgaactgattgaagagccctctggaaaacagatatcccaaagtattcttcttttgcttcagccattacaaacagtgattcagaaacttcataacaaggcatattcaattggattagcattgtctaccctttggaatcagctatctcttcttcctgttccatactcaaaagaacaaatacaaatggatgactatggcctttgtcagtgttgcaaggccttaatagagttcactaagccttttgtggaagaagtcattgataacaaagaaaactcactggaaaatgaaaagttaaaggatgaattactgaaattttgtttcaaaagcttgaaatgccctttgctgacagcacaattctttgaacagtctgaagaaggtggaaatgatcctttcaggtattttgcatcagaaataataggttttttatcagcaattggacaccctttccccaaaatgatttttaatcatggaaggaaaaagagaacttggaattaccttgaatttgaagaagaagaaaataaacagttagcagactcaatggcttctctggcatatctagtatttgtacagggcatccatattgatcagcttccaatggtcttaagcccattgtaccttttgcagtttaatatggggcacattgaagtctttttgcaaagaacagaagagtctgttatctccaaaggattggagctgctggagaatagtttattgagaatagaagacaatagtctactttaccagtacttagaaatcaagagttttcttactgtacctcagggcttagtgaaagtaatgacactttgccccattgagacactgaggaaaaagagtttagctatgcttcagctgtatattaacaagttggattcacaaggcaaatatacattatttagagaacacgtaacaacaaatggtttacaggaccacagttgatttcccttcttgatttggtactttttctcccagagggtgcagaaacagatttactgcaaaactcagataggattatggcttcattaaatttattgaggtatttggttatcaaagataatgaaaatgacaatcaaactggattatggacagaacttggaaatattgagaataatttcttaaagccacttcatataggacttaatatgtcaaaagcacattatgaagcagaaattaaaaatagccaagaggcccagaaatctaaagatctttgttctataactgtaagtggagaagagatccctaatatgcctcctgaaatgcagcttaaggtcctgcattcagctcttttcacatttgatttgattgaaagtgttctagctcgagtggaagaactcattgaaataaaaacaaagtctacctctgaagaaaatattgggataaagtgaaagttccatttcctaaataaaaactaataaaatatagtactttc

SEQ ID NO: 286844 - DNA, 1493 bp, Homo sapiens
tttccatcagtaggaaagggaaagcatcctctagaactagatccgtggtgtggatatcaattgaaaggccatacttgggatgaaggcataaataaggtagagtcattgtggagatggctcatagaggaagagacgtctgtgaatttatcctcaaataattttctcataaataaaacttaacaagttaatagatctcaaaacctggagctatccaaatggtgcagtgataagcgtagtgccccaagtacatttttcttttaattggtattcacataactagctatagtaataattattaaatagtgaagtccattgtgaaaagcaagggccatgtttcatttatttttgttttttgagcttttatcgcgtttaatagtaggcaatcaatcattgttgaactaaataactcattctttcattcttaacagactgactggattatggacagaacttggaaatattgagaataatttcttaaagccacttcatataggacttaatatgtcaaaagcacattatgaagcagaaattaaaaatagccaagaggcccagaaatctaaagatctttgttctataactgtaagtggagaagagatccctaatatgcctcctgaaatgcagcttaaggtcctgcattcagctcttttcacatttgatttgattgaaagtgttctagctcgagtggaagaactcattgaaataaaaacaaagtctacctctgaagaaaatattgggataaagtgaaagttccatttcctaaataaaaactaataaaatatagtactttccattatgattcatttaatacctttataaaaaatttttctgtaaaaatttactgcttgaaaaataaatgtagcttttctcatttatcaatttctataatgatacactatagaacaggtttttttggttttaaagttatctaatggtaaataatgcccacatatgtcctaaatactacttttgaaaatccaatacaaactaataattttataacttcataaaatgtagctgaattgtctatattcattcctacagttttagtgagcttataaaaatactgatacactttctgctgcagttagatgctatgtaacatttcggaactcctagtgtcaagttggctatcataccagtgtaaagaggccagttgacttttcttagcttctcttttcctggctcaggtggagtctttgggagcagagtcccatcaccacctctccagcagaagttataataggaaaacatctgcaaagattaattttagaaatacttgctacctttatggaaaaaaactaaaaaatatatatgactttaagaaactgattagaaaattctgtatttttatttcctactaaagatttgtccatttaactcactaagaagctacacctgagttttatggtatatgtatgtatcagtcctttgctaaagagcgttaaatcttgcagcgaaactcctaaaataaaatcacttttaattgtaaatgt

SEQ ID NO: 286845 - DNA, 436 bp, Homo sapiens
cagaagagcgggctaagacgccggaggaggtggcggcggctgggagaggcgagggttctggccgattttagcatcgaaactaggagaaataagaatggctgtagaggaacttcagtctataataaagagatgtgtaagtattaatttttgtaaaattaaatacctttcaaaatatgggaagggcacagattgtttttaattatatttgtggtcactcaaattgtttatcttctttaatccttgctttttttgacctgtaaagagcatgagtgggggaggcagattggattatttctccaggtgacatacttatctaaataaccttttacattttaatcctgatccttttcatagatttcactggtacagtagatttcaaggtcacttattaaagtatttattagggtaatcctaattttgatacgtgtgttattta

SEQ ID NO: 286846 - DNA, 1947 bp, Homo sapiens
cagaagagcgggctaagacgccggaggaggtggcggcggctgggagaggcgagggttctggccgattttagcatcgaaactaggagaaataagaatggctgtagaggaacttcagtctataataaagagatgtcaaatcctagaagagcaagactttaaagaagaggattttggcctatttcagttagctgggcaaagatgcatagaagaagggcacacagaccagctattagaaattattcaaaatgaaaagaataaggtcatcatcaagaatatgggctggaatctcgttggtcctgttgttcgatgccttttgtgtaaagataaagaggatagtaaaagaaaagtttattttttgatctttgatttattggtaaaggttcaattgtgaatatttttatagttatgcaatccaaaggaattattgttgggtttgcttgaactgattgaagagccctctggaaaacagatatcccaaagtattcttcttttgcttcagccattacaaacagtgattcagaaacttcataacaaggcatattcaattggattagcattgtctaccctttggaatcagctatctcttcttcctgttccatactcaaaagaacaaatacaaatggatgactatggcctttgtcagtgttgcaaggccttaatagagttcactaagccttttgtggaagaagtcattgataacaaagaaaactcactggaaaatgaaaagttaaaggatgaattactgaaattttgtttcaaaagcttgaaatgccctttgctgacagcacaattctttgaacagtctgaagaaggtggaaatgatcctttcaggtattttgcatcagaaataataggttttttatcagcaattggacaccctttccccaaaatgatttttaatcatggaaggaaaaagagaacttggaattaccttgaatttgaagaagaagaaaataaacagttagcagactcaatggcttctctggcatatctagtatttgtacagggcatccatattgatcagcttccaatggtcttaagcccattgtaccttttgcagtttaatatggggcacattgaagtctttttgcaaagaacagaagagtctgttatctccaaaggattggagctgctggagaatagtttattgagaatagaagacaatagtctactttaccagtacttagaaatcaagagttttcttactgtacctcagggcttagtgaaagtaatgacactttgccccattgagacactgaggaaaaagagtttagctatgcttcagctgtatattaacaagttggattcacaaggcaaatatacattatttaggtgcttattgaatacaagtaatcactcaggtgtggaggcttttattattcaaaatatcaaaaatcaaattgacatgtcattaaagagaacacgtaacaacaaatggtttacaggaccacagttgatttcccttcttgatttggtactttttctcccagagggtgcagaaacagatttactgcaaaactcagataggattatggcttcattaaatttattgaggtatttggttatcaaagataatgaaaatgacaatcaaactggattatggacagaacttggaaatattgagaataatttcttaaagccacttcatataggacttaatatgtcaaaagcacattatgaagcagaaattaaaaatagccaagaggcccagaaatctaaagatctttgttctataactgtaagtggagaagagatccctaatatgcctcctgaaatgcagcttaaggtcctgcattcagctcttttcacatttgatttgattgaaagtgttctagctcgagtggaagaactcattgaaataaaaacaaagtctacctctgaagaaaatattgggataaagtgaaagttccatttcctaaataaaaactaataaaatatagtactttc

SEQ ID NO: 286847 - DNA, 2652 bp, Homo sapiens
cagaagagcgggctaagacgccggaggaggtggcggcggctgggagaggcgagggttctggccgattttagcatcgaaactaggagaaataagaatggctgtagaggaacttcagtctataataaagagatgtcaaatcctagaagagcaagactttaaagaagaggattttggcctatttcagttagctgggcaaagatgcatagaagaagggcacacagaccagctattagaaattattcaaaatgaaaagaataaggtcatcatcaagaatatgggctggaatctcgttggtcctgttgttcgatgccttttgtgtaaagataaagaggatagtaaaagaaaagtttattttttgatctttgatttattggtaaaggttcaattgtgaatatttttatagttatgcaatccaaaggaattattgttgggtttgcttgaactgattgaagagccctctggaaaacagatatcccaaagtattcttcttttgcttcagccattacaaacagtgattcagaaacttcataacaaggcatattcaattggattagcattgtctaccctttggaatcagctatctcttcttcctgttccatactcaaaagaacaaatacaaatggatgactatggcctttgtcagtgttgcaaggccttaatagagttcactaagccttttgtggaagaagtcattgataacaaagaaaactcactggaaaatgaaaagttaaaggatgaattactgaaattttgtttcaaaagcttgaaatgccctttgctgacagcacaattctttgaacagtctgaagaaggtggaaatgatcctttcaggtattttgcatcagaaataataggttttttatcagcaattggacaccctttccccaaaatgatttttaatcatggaaggaaaaagagaacttggaattaccttgaatttgaagaagaagaaaataaacagttagcagactcaatggcttctctggcatatctagtatttgtacagggcatccatattgatcagcttccaatggtcttaagcccattgtaccttttgcagtttaatatggggcacattgaagtctttttgcaaagaacagaagagtctgttatctccaaaggattggagctgctggagaatagtttattgagaatagaagacaatagtctactttaccagtacttagaaatcaagagttttcttactgtacctcagggcttagtgaaagtaatgacactttgccccattgagacactgaggaaaaagagtttagctatgcttcagctgtatattaacaagttggattcacaaggcaaatatacattatttaggtgcttattgaatacaagtaatcactcaggtgtggaggcttttattattcaaaatatcaaaaatcaaattgacatgtcattaaagagaacacgtaacaacaaatggtttacaggaccacagttgatttcccttcttgatttggtactttttctcccagagggtgcagaaacagatttactgcaaaactcagataggattatggcttcattaaatttattgaggtatttggttatcaaagataatgaaaatgacaatcaaactggattatggacagaacttggaaatattgagaataatttcttaaagccacttcatataggacttaatatgtcaaaagcacattatgaagcagaaattaaaaatagccaagaggcccagaaatctaaagatctttgttctataactgtaagtggagaagagatccctaatatgcctcctgaaatgcagcttaaggtcctgcattcagctcttttcacatttgatttgattgaaagtgttctagctcgagtggaagaactcattgaaataaaaacaaagtctacctctgaagaaaatattgggataaagtgaaagttccatttcctaaataaaaactaataaaatatagtactttccattatgattcatttaatacctttataaaaaatttttctgtaaaaatttactgcttgaaaaataaatgtagcttttctcatttatcaatttctataatgatacactatagaacaggtttttttggttttaaagttatctaatggtaaataatgcccacatatgtcctaaatactacttttgaaaatccaatacaaactaataattttataacttcataaaatgtagctgaattgtctatattcattcctacagttttagtgagcttataaaaatactgatacactttctgctgcagttagatgctatgtaacatttcggaactcctagtgtcaagttggctatcataccagtgtaaagaggccagttgacttttcttagcttctcttttcctggctcaggtggagtctttgggagcagagtcccatcaccacctctccagcagaagttataataggaaaacatctgcaaagattaattttagaaatacttgctacctttatggaaaaaaactaaaaaatatatatgactttaagaaactgattagaaaattctgtatttttatttcctactaaagatttgtccatttaactcactaagaagctacacctgagttttatggtatatgtatgtatcagtcctttgctaaagagcgttaaatcttgcagcgaaactcctaaaataaaatcacttttaattgtaaatgt

SEQ ID NO: 286848 - DNA, 1842 bp, Homo sapiens
cagaagagcgggctaagacgccggaggaggtggcggcggctgggagaggcgagggttctggccgattttagcatcgaaactaggagaaataagaatggctgtagaggaacttcagtctataataaagagatgtcaaatcctagaagagcaagactttaaagaagaggattttggcctatttcagttagctgggcaaagatgcatagaagaagggcacacagaccagctattagaaattattcaaaatgaaaagaataaggtcatcatcaagaatatgggctggaatctcgttggtcctgttgttcgatgccttttgtgtaaagataaagaggatagtaaaagaaaagtttattttttgatctttgatttattggtaaaggttcaattgtgaatatttttatagttatgcaatccaaaggaattattgttgggtttgcttgaactgattgaagagccctctggaaaacagatatcccaaagtattcttcttttgcttcagccattacaaacagtgattcagaaacttcataacaaggcatattcaattggattagcattgtctaccctttggaatcagctatctcttcttcctgttccatactcaaaagaacaaatacaaatggatgactatggcctttgtcagtgttgcaaggccttaatagagttcactaagccttttgtggaagaagtcattgataacaaagaaaactcactggaaaatgaaaagttaaaggatgaattactgaaattttgtttcaaaagcttgaaatgccctttgctgacagcacaattctttgaacagtctgaagaaggtggaaatgatcctttcaggtattttgcatcagaaataataggttttttatcagcaattggacaccctttccccaaaatgatttttaatcatggaaggaaaaagagaacttggaattaccttgaatttgaagaagaagaaaataaacagttagcagactcaatggcttctctggcatatctagtatttgtacagggcatccatattgatcagcttccaatggtcttaagcccattgtaccttttgcagtttaatatggggcacattgaagtctttttgcaaagaacagaagagtctgttatctccaaaggattggagctgctggagaatagtttattgagaatagaagacaatagtctactttaccagtacttagaaatcaagagttttcttactgtacctcagggcttagtgaaagtaatgacactttgccccattgagacactggaggtacaagtgtggatgtattacatgcataaaatggatagtgatgaagtctggagaacacgtaacaacaaatggtttacaggaccacagttgatttcccttcttgatttggtactttttctcccagagggtgcagaaacagatttactgcaaaactcagataggattatggcttcattaaatttattgaggtatttggttatcaaagataatgaaaatgacaatcaaactggattatggacagaacttggaaatattgagaataatttcttaaagccacttcatataggacttaatatgtcaaaagcacattatgaagcagaaattaaaaatagccaagaggcccagaaatctaaagatctttgttctataactgtaagtggagaagagatccctaatatgcctcctgaaatgcagcttaaggtcctgcattcagctcttttcacatttgatttgattgaaagtgttctagctcgagtggaagaactcattgaaataaaaacaaagtctacctctgaagaaaatattgggataaagtgaaagttccatttcctaaataaaaactaataaaatatagtactttc

SEQ ID NO: 286849 - DNA, 1797 bp, Homo sapiens
cagaagagcgggctaagacgccggaggaggtggcggcggctgggagaggcgagggttctggccgattttagcatcgaaactaggagaaataagaatggctgtagaggaacttcagtctataataaagagatgtgtcatcatcaagaatatgggctggaatctcgttggtcctgttgttcgatgccttttgtgtaaagataaagaggatagtaaaagaaaagtttattttttgatctttgatttattggtaaagttatgcaatccaaaggaattattgttgggtttgcttgaactgattgaagagccctctggaaaacagatatcccaaagtattcttcttttgcttcagccattacaaacagtgattcagaaacttcataacaaggcatattcaattggattagcattgtctaccctttggaatcagctatctcttcttcctgttccatactcaaaagaacaaatacaaatggatgactatggcctttgtcagtgttgcaaggccttaatagagttcactaagccttttgtggaagaagtcattgataacaaagaaaactcactggaaaatgaaaagttaaaggatgaattactgaaattttgtttcaaaagcttgaaatgccctttgctgacagcacaattctttgaacagtctgaagaaggtggaaatgatcctttcaggtattttgcatcagaaataataggttttttatcagcaattggacaccctttccccaaaatgatttttaatcatggaaggaaaaagagaacttggaattaccttgaatttgaagaagaagaaaataaacagttagcagactcaatggcttctctggcatatctagtatttgtacagggcatccatattgatcagcttccaatggtcttaagcccattgtaccttttgcagtttaatatggggcacattgaagtctttttgcaaagaacagaagagtctgttatctccaaaggattggagctgctggagaatagtttattgagaatagaagacaatagtctactttaccagtacttagaaatcaagagttttcttactgtacctcagggcttagtgaaagtaatgacactttgccccattgagacactgaggaaaaagagtttagctatgcttcagctgtatattaacaagttggattcacaaggcaaatatacattatttaggtgcttattgaatacaagtaatcactcaggtgtggaggcttttattattcaaaatatcaaaaatcaaattgacatgtcattaaagagaacacgtaacaacaaatggtttacaggaccacagttgatttcccttcttgatttggtactttttctcccagagggtgcagaaacagatttactgcaaaactcagataggattatggcttcattaaatttattgaggtatttggttatcaaagataatgaaaatgacaatcaaactggattatggacagaacttggaaatattgagaataatttcttaaagccacttcatataggacttaatatgtcaaaagcacattatgaagcagaaattaaaaatagccaagaggcccagaaatctaaagatctttgttctataactgtaagtggagaagagatccctaatatgcctcctgaaatgcagcttaaggtcctgcattcagctcttttcacatttgatttgattgaaagtgttctagctcgagtggaagaactcattgaaataaaaacaaagtctacctctgaagaaaatattgggataaagtgaaagttccatttcctaaataaaaactaataaaatatagtactttc

SEQ ID NO: 286850 - DNA, 530 bp, Homo sapiens
cagaagagcgggctaagacgccggaggaggtggcggcggctgggagaggcgagggttctggccgattttagcatcgaaactaggagaaataagaatggctgtagaggaacttcagtctataataaagagatgtcaaatcctagaagagcaagactttaaagaagaggattttggcctatttcagttagctgggcaaagatgcatagaagaagggcacacagaccagctattagaaattattcaaaatgaaaagaataaggtgcgtacaatcttggtgtttacttttcagtcttgggaagagaataatcacatgatgctattcatccagtcatttatccatcaaacatttaagaatctacttaaattttcacagtagggaactgaaaacaaaaaaagaattagaaatatttaggccaggcgcagtggctcacgttcgtaatcacagcgttatgggaggccaaggcaggcagatcacttgagcccaggagtttgagaccagcctgggcaacagagtaagaccctgtctcaga

SEQ ID NO: 286851 - DNA, 516 bp, Homo sapiens
gcccaagctggagtgcagtggcatgattgtggctcactgcagcttcaactccctgggctcaagtgatccacccacctcagattcctgattagccaggactgcaggtgcacaccaccatgcctggctaatttttagtagagatagggtctcactatgttgctcaggctggtctccaactcctggcctctagtaatcctctcagctcagcctcccaaagcacaggaattacaggtgcaaaccactgtacctggtcttaaatattcctaagctacctccagctgaaatcttttctgtgttttgctttgttttgctttaaaggcagcattaataacattactttttcttggcattgcaggtcctgcattcagctcttttcacatttgatttgattgaaagtgttctagctcgagtggaagaactcattgaaataaaaacaaagtctacctctgaagaaaatattgggataaagtgaaagttccatttcctaaataaaaactaataaaatatagtactttc

SEQ ID NO: 286852 - DNA, 731 bp, Homo sapiens
ggttgggccagccagggcaggcagggacagcccctctgatgaggaggccactgggctgagaccaatgaatgagatggagccagccacgtggtgagccagaagagggcatcacagggcttgagtctgggggagcctggctgcccagaggtggcagatgacatgaagaaataaccatgtaagggctggctgtgtatgagagcaagcattgggaaggatgaatgccaactatgttccaggaacttccactgttctcacacacccaggtgagtggtgttcaggtgggtggcacccaggtgagtgacatcccagttgagtggcacccaggtgagtagcatccaggtgagtgacacctaggtgagtgacattcaggttagtggcgtctgtgtgagtggcatcatccaggtgagtagcttccaggtgagtggcacccaggtgagtggcattcgggtgagtggcattatccaggtgacacctgggtgagtggcatccaggtgagtgatatcatccaggtaagtggcacctaggtgacatccaggtgagtgacgacatccaggtgagtgacatcatccaggtaaatggcacccaggtgagtagcattcaggtgagtgacacccaggcgagtggcatccacgtgactagcattgtccaggtgcataacacccaggtgagtggcacccagttgagtggtgcccaagtgagtcacatccaggtaagtggggtccaggtggtgg

SEQ ID NO: 286853 - DNA, 869 bp, Homo sapiens
ggttgggccagccagggcaggcagggacagcccctctgatgaggaggccactgggctgagaccaatgaatgagatggagccagccacgtggtgagccagaagagggcatcacagtgttcaggtccatgaaatgggctcccgaagtccaacctcacagaccccataggaaagcagatggaatctccaagggcaccagctatacatggtggtggaaggaccaacgcatgctctgaatgccactgcggaccacagggcttgagtctgggggagcctggctgcccagaggtggcagatgacatgaagaaataaccatgtaagggctggctgtgtatgagagcaagcattgggaaggatgaatgccaactatgttccaggaacttccactgttctcacacacccaggtgagtggtgttcaggtgggtggcacccaggtgagtgacatcccagttgagtggcacccaggtgagtagcatccaggtgagtgacacctaggtgagtgacattcaggttagtggcgtctgtgtgagtggcatcatccaggtgagtagcttccaggtgagtggcacccaggtgagtggcattcgggtgagtggcattatccaggtgacacctgggtgagtggcatccaggtgagtgatatcatccaggtaagtggcacctaggtgacatccaggtgagtgacgacatccaggtgagtgacatcatccaggtaaatggcacccaggtgagtagcattcaggtgagtgacacccaggcgagtggcatccacgtgactagcattgtccaggtgcataacacccaggtgagtggcacccagttgagtggtgcccaagtgagtcacatccaggtaagtggggtccaggtggtgg

SEQ ID NO: 286854 - DNA, 701 bp, Homo sapiens
ggttgggccagccagggcaggcagggacagcccctctgatgaggaggccactgggctgagaccaatgaatgagatggagccagccacgtggtgagccagaagagggcatcacagggcttgagtctgggggagcctggctgcccagaggtggcagatgacatgaagaaataaccatgtaagggctggctgtgtatgagagcaagcattgggaaggatgaatgccaactatgttccaggaacttccactgttctcacacacccaggtgagtggtgttcaggtgggtggcacccaggtgagtgacatcccagttgagtggcacccaggtgagtagcatccaggtgagtgacacctaggtgagtgacattcaggttagtggcgtctgtgtgagtggcatcatccaggtgagtagcttccaggtgagtggcacccaggtgagtggcattcgggtgatggcatccaggtgagtgatatcatccaggtaagtggcacctaggtgacatccaggtgagtgacgacatccaggtgagtgacatcatccaggtaaatggcacccaggtgagtagcattcaggtgagtgacacccaggcgagtggcatccacgtgactagcattgtccaggtgcataacacccaggtgagtggcacccagttgagtggtgcccaagtgagtcacatccaggtaagtggggtccaggtggtgg

SEQ ID NO: 286855 - DNA, 697 bp, Homo sapiens
agggcaggcaggggcggcctctctgacgagaaggaggccactgggctgaggccaatgaatgggaaagagccagccatgtgggcttgagtctgggggagcctggctgcccagaggtggcagatgacatgaagaaataaccatgtaagggctggctgtgtatgagagcaagcattgggaaggatgaatgccaactatgttccaggaacttccactgttctcacacacccaggtgagtggtgttcaggtgggtggcacccaggtgagtgacatcccagttgagtggcacccaggtgagtagcatccaggtgagtgacacctaggtgagtgacattcaggttagtggcgtctgtgtgagtggcatcatccaggtgagtagcttccaggtgagtggcacccaggtgagtggcattcgggtgagtggcattatccaggtgacacctgggtgagtggcatccaggtgagtgatatcatccaggtaagtggcacctaggtgacatccaggtgagtgacgacatccaggtgagtgacatcatccaggtaaatggcacccaggtgagtagcattcaggtgagtgacacccaggcgagtggcatccacgtgactagcattgtccaggtgcataacacccaggtgagtggcacccagttgagtggtgcccaagtgagtcacatccaggtaagtggggtccaggtggtgg

SEQ ID NO: 286856 - DNA, 842 bp, Homo sapiens
cccacgtcatggcgcctgaggagaacgcgggtaccaaactcttgctgcagagtttcgagcgccgcttcctagcggcgcgcacactgcgctccttcccctggcagtaacctgaagctttcaccgtagacgtgctgtattgcccagaagccatcgtgtccctggtcggggtcctgcggaggctggctgcctgctgggagcaccagcgggctcctgaggtctacatggcctttaccgtccgcaacccagagacgtgccagctgttcaccaccgagctaggctgggctgggatcagatgggaagcggaagctcatcatgaccagaaactgtttccctatggagagcacttggagatggcaatgctgaacctcacactgtaggactcatacacgactccaacgggattgttagaatcaaatcactctcgtgggaagaatttttatatgggaaagcggataaaactttcattggactggaatgtttggagaatgttaaattccaaatcaggaaccacaatctgccctctaataagacatcggctatctaagcatgtgggtgccccctttctgccagcagttctggttcttaagaaaatcaccataaatcagacatgaaaattctggctccaaaaatagcattttctttgtgcaaataaaaacgtgtgtatcaagtatgacgttcccccaacgtggacacactcggttcctcacaaagccaagcccgctgcagctgccacatccctggacacactcggttcctcacaaagccaagctcgctgcagctgccacatccctggacacattcggttcctcacaaagccaagcccgcggcagctgccacatccc

SEQ ID NO: 286857 - DNA, 820 bp, Homo sapiens
gtgacagtggcccagctggactgggacgtagcgacggtccatcagctctctgccttccagccagatgttgtcattacagcagtaacctgaagctttcaccgtagacgtgctgtattgcccagaagccatcgtgtccctggtcggggtcctgcggaggctggctgcctgctgggagcaccagcgggctcctgaggtctacatggcctttaccgtccgcaacccagagacgtgccagctgttcaccaccgagctaggctgggctgggatcagatgggaagcggaagctcatcatgaccagaaactgtttccctatggagagcacttggagatggcaatgctgaacctcacactgtaggactcatacacgactccaacgggattgttagaatcaaatcactctcgtgggaagaatttttatatgggaaagcggataaaactttcattggactggaatgtttggagaatgttaaattccaaatcaggaaccacaatctgccctctaataagacatcggctatctaagcatgtgggtgccccctttctgccagcagttctggttcttaagaaaatcaccataaatcagacatgaaaattctggctccaaaaatagcattttctttgtgcaaataaaaacgtgtgtatcaagtatgacgttcccccaacgtggacacactcggttcctcacaaagccaagcccgctgcagctgccacatccctggacacactcggttcctcacaaagccaagctcgctgcagctgccacatccctggacacattcggttcctcacaaagccaagcccgcggcagctgccacatccc

SEQ ID NO: 286858 - DNA, 486 bp, Homo sapiens
ctcagaaacacaaaatgatcctctgacaagtgatgaagaagaatgggaagatgtgaaaatccaagcaagaagaacttaggggaagcaactcaacatctaagaagaaatgaatagggatcagttccaagaagagataaaggggaaatacccaagaactgggatgcttcgtctttggtttcttctggatcctccctaaattttggctaagaaatctgagtctccatttaagagtgttcccagaaatgatgacatccacatccaggaacctcctccttccttcacttgaactctcttgcttctggggagccaggacctatggagtaaaaatcaagttcatttggtgacacattccctccgggcccagatgctgtctctgctgctgtaaactctcctgcagtcaaggccaagcaatatatctaagcatccctttgtcaggtgtccccaagtctttacatcccagggcaataaaacaacactctgaaaaaa

SEQ ID NO: 286859 - DNA, 1069 bp, Homo sapiens
tcagcgttctcctgcggaacctttgaacggggtactcgagcccacaggggaagagcagcggaaggggcctttcggaacgatttggaacgaaaggaagtggaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagtaagtggttgtatgatgccaatactgactcaaaccaacctttggatagaaaagtgtttgaggagtgaggtaaagaatgacacttccccttcataccaatgtccattaagcagattgcttatttaaaatgttaacactcatcacattttatctatgttgaataaaagtggttctgtgtgattgtcatttatatctgatccccaaatagctcatacaataatccattcaatagaatggaattaaaactgttcagaatgattttccaactagcaaatataagtatgcctggttaagatatcttccctttgtagaaatgttacattgggatggatagtggtgctgtcacagaaggacaaaatattcctagacgagtctatcctcaaaccagtagtgtcttttacatgaagagatgatttacacctaatagacattgaatatgatagacatacatgtatatatgtatcagttctgagttccactggcctatcc

SEQ ID NO: 286860 - DNA, 764 bp, Homo sapiens
tcagcgttctcctgcggaacctttgaacggggtactcgagcccacaggggaagagcagcggaaggggcctttcggaacgatttggaacgaaaggaagtggaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagtaagtggttgtatgatgccaatactgactcaaaccaacctttggatagaaaagtgtttgaggagtgaggtaaagaatgacacttccccttcataccaatgtccattaagcagattgcttatttaaaatgttaacactcatcacattttatctatgttgaataaaagtggttctgtgtgattgt

SEQ ID NO: 286861 - DNA, 2455 bp, Homo sapiens
tcagcgttctcctgcggaacctttgaacggggtactcgagcccacaggggaagagcagcggaaggggcctttcggaacgatttggaacgaaaggaagtggaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcggtaagaatttttttttctattagtaaggcctttgcaaatatgaccaaaatgtttttctttttaaaacgagatctggtattagactctaacatcttttattttagctacttgaatagagttctgccgtaggacaaaacaatttgataattactctgagttcagaaatgatgatgaattgattgtagtcatgtagtcagttgagttttgaagtaggggaattcctagattagaagcaaagctgctataataccatatttttcttcctagatcttaaatttaaggatatgtgatttgggaattgttttttttttttttacatagccctttgtaagcaaatgatatgggaattttaaaaggtagtttgggtgagcagaattttagataactgaaaagagactgtacaaagcttagctataggttggctatagtattaacatggactttctgaaagcacaggttcttgctacatgcaaaggtattttgacactaattagaccatacaaagcacttggcacagagctgaagagtagttacgtgagctgaatgtaaattggaaagtttgaggaattggaaaaaacaaaagaacttgtctagtttctctgagcatctgtcttggtaatctaatccatgcaccatactttaagaaagtaaagggacattatttcttttttagttcataaatcccactttgtctctaatcaaagttatggaccctctccacagaaaaaggcacacagtcccattcatttgaagttttgcatacgattacagggagtcatgggcttcaaagccatttctagattaagaacctctatcctggagacagccatactgactgtaggaaggaggcactgtgacaaaagcattagaggcagtggtggtaacagaaaagccaaaaagactgatacaaacttatatagtagcctggggtgataaagtcaaagaaccttttattacagtaagtcatgggccattatctgtgtataaaaatagtgataaaatacttgatagagacatggggatggataaattagggattgtactcatttaagaatggcatatgttatctattgtgttgtaagtttccttaaatctaaaaattttttcattatctacaatctgagcaaagcattggaacactttcttatcagacatcatttttgttctgccataaaattttattctatgaagattgtactttattccagaatcttcccatgcgttaatccgtaggctaaactaaaacaaaataaagtgcttatacaaaatatgtacacagtaagaaaggtataactaatcctttgaatggatttgaatgtagaatagtaaccttttaaaattcagaattaacacatcctattatcagacttttcgtttttttccctagcccatttcaatggaaaatccttataaagaacctcttaagaaatgtatcttgtgtggaaagcatgtagattataagaatgtacagctgagatctggttttacttcactatattttagggttttgcttctgatagatctgcttaaagagaatcaagtcagtttatagcaggcttttgtagaggtaactgttttagcaacttcataatttcaaatttggttataattctatgtataagcttatctctgctttattcaagtaaaagcaccttggctttcccccacttactgttatttccactctgtttttttcactaccccaaacatcttaatagctccctgtggcagtaattctcaattggtgagggtcagaactttggaaaaagctcatctggtgaagctgatctctttatctcaccacccatatcactgattcacatattacttatctcttgtctaactctcagcaagttagaagttgcaaatttggggcaagtgaatagcgctagaattctgtatgttggctgggtgtggtggctcacgcctgtaatcccagcactttgggaggccaaggcgggcggatcacctgaggtcaggagtttgagaccagcctggccaatgtggtgaaaccccgtctctattaaaaatacaaaaattagctgagtgtggtggtgcatgcctgtaatcccagccacttgggaggctgaggcaggagatttgcttgaacccaggaggcggaagttgcagtgagctgagatcgtgccattgcactccagcctgggtgacaagagtaaaactctgtcca

SEQ ID NO: 286862 - DNA, 756 bp, Homo sapiens
  misc_feature (662)..(662): n is a, c, g, or t
tcagcgttctcctgcggaacctttgaacggggtactcgagcccacaggggaagagcagcggaaggggcctttcggaacgatttggaacgaaaggaagtggaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacaggtcttgctctgtcacccaggtcatgcagtggcatgacctcggctcacttcggcctctttcttctgagctcaagtgatcctnctgcctcagcctccccagtggctgagactacagaagcatgccatcacctctgggctaatttttgatttttagtggagacagtgtttaccatgtc

SEQ ID NO: 286863 - DNA, 985 bp, Homo sapiens
tcagcgttctcctgcggaacctttgaacggggtactcgagcccacaggggaagagcagcggaaggggcctttcggaacgatttggaacgaaaggaagtggaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagtaagtggttgtatgatgccaatactgactcaaaccaacctttggatagaaaagtgtttgaggagtgaggtaaagaatgacacttccccttcataccaatgtccattaagcagattgcttatttaaaatgttaacactcatcacattttatctatgttgaataaaagtggttctgtgtgattgtcatttatatctgatccccaaatagctcatacaataatccattcaatagaatggaattaaaactgttcagaatgattttccaactagcaaatataagtatgcctggttaagatatcttccctttgtagaaatgttacattgggatggatagtggtgctgtcacagaaggacaaaatattcctagacgagtctatcctcaaaccagtagtgtcttttacatgaagagatgatttacacctaatagacattgaatatgatagacatacatgtatatatgtatcagttctgagttccactggcctatcc

SEQ ID NO: 286864 - DNA, 975 bp, Homo sapiens
tcagcgttctcctgcggaacctttgaacggggtactcgagcccacaggggaagagcagcggaaggggcctttcggaacgatttggaacgaaaggaagtggaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagtgaagaaatacaactcagtcaatgaagctaaaggaataatgacatctcgttcaacaagggacagcatctatgatggggtctcacaagattatattggagcacatatagaaagctgatatatagcacttgatattggcattacagatcaaataggggaaatgactgatattcaataataatttggggacatttggttttccctatgaaaactaaaaagtaaaaatacatataggtttgtgtaagtatatgtttgcacaatgataaaactgcctaatgacacatttctcagaaggtacatagccttcattaagcaactcataactgtataaatctaatcaagatgtcaggttatcctaaaaaatgtcagtcattaacttgatatgaactctatctagaagtggttgacgtgtttgatatgttaacttacctttaattcctcttgtaatgaagcatacatttcatttatcttatgtacctc

SEQ ID NO: 286865 - DNA, 734 bp, Homo sapiens
  misc_feature (2)..(2): n is a, c, g, or t
  misc_feature (734)..(734): n is a, c, g, or t
cncgcgaacgcggccgcgcgacacggctgcgagagacgacagaaggggacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagcaaaaaaaaaaaaaaaaaaaaaaaaaaaaatgtttgggggggtgggcgaaaaaattttaaaaaccattcgtggtggggcggccgggcccaaggatagggacaggcggaccaggggccacagaaggggtccaaaggaagaacttgggccaaggaacagggtggtgggttcctcaccaaaaaaaaaacgccggggggaagcccaggcggttgttgcccaactccaaaggggatgcggagggctcaggggctccacacaagggcctcaacgagaggcgagaaaaataccgccggggggggn

SEQ ID NO: 286866 - DNA, 443 bp, Homo sapiens
tcagcgttctcctgcggaacctttgaacggggtactcgagcccacaggggaagagcagcggaaggggcctttcggaacgatttggaacgaaaggaagtggaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtccagtttgttctcatttctgatgcattatggaggacattcaggcttttgtggaggacagagatccaagcattagagctaatatgggt

SEQ ID NO: 286867 - DNA, 1015 bp, Homo sapiens
tcagcgttctcctgcggaacctttgaacggggtactcgagcccacaggggaagagcagcggaaggggcctttcggaacgatttggaacgaaaggaagtggaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagtaagtggttgtatgatgccaatactgactcaaaccaacctttggatagaaaagtgtttgaggagtgaggtaaagaatgacacttccccttcataccaatgtccattaagcagattgcttatttaaaatgttaacactcatcacattttatctatgttgaataaaagtggttctgtgtgattgtcatttatatctgatccccaaatagctcatacaataatccattcaatagaatggaatttatcttccctttgtagaaatgttacattgggatggatagtggtgctgtcacagaaggacaaaatattcctagacgagtctatcctcaaaccagtagtgtcttttacatgaagagatgatttacacctaatagacattgaatatgatagacatacatgtatatatgtatcagttctgagttccactggcctatcc

SEQ ID NO: 286868 - DNA, 1018 bp, Homo sapiens
tcagcgttctcctgcggaacctttgaacggggtactcgagcccacaggggaagagcagcggaaggggcctttcggaacgatttggaacgaaaggaagtggaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagacagggtctcactcagtctcccaggctgcagtgcagtggtgcgatcatggctcaataatgcagcttcaacctcccgtgctcaagcaatcctcttgcctcagcctcccaagtagctgggactacaggcacccatcaccacacccgactaatttttaagttttttgtagagatgaggtctcctaatgttgctcagtgatcctcctgccttggcctcccaaagtgctgggattacaggtatgagtcaccacactgggcccagatgacatgtaaagctgtgaaatgtgcttagtataatagtgtggaaaaacagtttaatggctcttttgattagtacatgtataaataaggcagtattgagatttaccctatcttccatgaacaataaaattattcttagttggtaaaaaaaaaaacacaaaagaagaacaaaaaaaacc

SEQ ID NO: 286869 - DNA, 879 bp, Homo sapiens
  misc_feature (879)..(879): n is a, c, g, or t
tcagcgttctcctgcggaacctttgaacggggtactcgagcccacaggggaagagcagcggaaggggcctttcggaacgatttggaacgaaaggaagtggaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagcaaaaaaaaaaaaaaaaaaaaaaaaaaaaatgtttgggggggtgggcgaaaaaattttaaaaaccattcgtggtggggcggccgggcccaaggatagggacaggcggaccaggggccacagaaggggtccaaaggaagaacttgggccaaggaacagggtggtgggttcctcaccaaaaaaaaaacgccggggggaagcccaggcggttgttgcccaactccaaaggggatgcggagggctcaggggctccacacaagggcctcaacgagaggcgagaaaaataccgccggggggggn

SEQ ID NO: 286870 - DNA, 1017 bp, Homo sapiens
tcagcgttctcctgcggaacctttgaacggggtactcgagcccacaggggaagagcagcggaaggggcctttcggaacgatttggaacgaaaggaagtggaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagctacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttattttacagtaagtggttgtatgatgccaatactgactcaaaccaacctttggatagaaaagtgtttgaggagtgaggtaaagaatgacacttccccttcataccaatgtccattaagcagattgcttatttaaaatgttaacactcatcacattttatctatgttgaataaaagtggttctgtgtgattgtcatttatatctgatccccaaatagctcatacaataatccattcaatagaatggaattaaaactgttcagaatgattttccaactagcaaatataagtatgcctggttaagatatcttccctttgtagaaatgttacattgggatggatagtggtgctgtcacagaaggacaaaatattcctagacgagtctatcctcaaaccagtagtgtcttttacatgaagagatgatttacacctaatagacattgaatatgatagacatacatgtatatatgtatcagttctgagttccactggcctatcc

SEQ ID NO: 286871 - DNA, 749 bp, Homo sapiens
ccataaatctgctggctttcaggagaacacgtcttgaagcacagctgaacttgaatcttttctgtggaaaaataattgaaaatatgaattaataattcttctcttgttgaagctgacagaaccaaggacacacaccttgttaacgacgccctcaaggctgtgaggagaaagacaaccgggtgaagcaacgctgggaattcaacgcatcaattaccttcccaggtaacagcagctacttgagctcctaagagttgaccttcagctgctgtcatggaaaatagtgggggtcaactagacatcaaagatgaaaggccaggcctccagcacaactttctctgtaagctcgatagtggctttctcaaagaaatccttttctcaaaaaaatttcttgtaaagacagggtcttgttctgtcacccaggctggactgcagtgcatggctcactgcagcctcaacctcccgggctagagtgatcctccccttttctgaggagctcagaccacaagcgtgcaccactgtgcccagctgatttataaactttttttttagagacagggtttcaccatgttggccaggctgttttcttttcttctctttttttgagatggagtttcactcttgttgcccaggctggagggcagtggcgcgatcttggctcactgcaacctccgcctcccaggttcaagtgattctcctgcctcccaagcagctgggattacagcgtagctgggattacaggcatgcgtcac

SEQ ID NO: 286872 - DNA, 880 bp, Homo sapiens
ctgacaccttgagtgcagcctgtgagaccctgagcagaggttcagcagtcccctccccggactcctgccacacagaagccatgaggcatccccatcacacactaggcttggtgactgcacttgagggactcacaggacttagcctaccatcatactagtggctgggatttactacggtgaaaagatgcgacgcagaattagtaacaggaagatgcatttggggtgagggccggaggaaaccagctgacagaaccaaggacacacaccttgttaacgacgccctcaaggctgtgaggagaaagacaaccgggtgaagcaacgctgggaattcaacgcatcaattaccttcccaggtaacagcagctacttgagctcctaagagttgaccttcagctgctgtcatggaaaatagtgggggtcaactagacatcaaagatgaaaggccaggcctccagcacaactttctctgtaagctcgatagtggctttctcaaagaaatccttttctcaaaaaaatttcttgtaaagacagggtcttgttctgtcacccaggctggactgcagtgcatggctcactgcagcctcaacctcccgggctagagtgatcctccccttttctgaggagctcagaccacaagcgtgcaccactgtgcccagctgatttataaactttttttttagagacagggtttcaccatgttggccaggctgttttcttttcttctctttttttgagatggagtttcactcttgttgcccaggctggagggcagtggcgcgatcttggctcactgcaacctccgcctcccaggttcaagtgattctcctgcctcccaagcagctgggattacagcgtagctgggattacaggcatgcgtcac

SEQ ID NO: 286873 - DNA, 1217 bp, Homo sapiens
taggttccaagaccaaagattaaattaataaaaggtgaagctggacaaaatctgctggaaatgatggcctgtgaccgactgagccaatcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtgtaagtagtaaaacaaaaatattgctttcacttagtgcgtaggttttaccggggatttaatcctcatgtgaagatttaatttgtcatgtgacccattaacatatatgtatgtaagcgctgaactgtgtatttagaaaacaattttagtaaattgaagtattttttagacctggaaactcagcagaattgagacttgtagttcagcatgaaataaacactctaagagcccaggaaaaacatggccttcaacctgctctgcttgtacattgggcaaaatgccttcagaaaatggtgagttttaaagtataagcatttttaaagaacattaccttaattttttaaaatcatgcactttttattgaaagtttttttgttcagaaaacagcagcttggtcatattatgacagatgtgttttttattgctgcaaaatagttaatgtagttaaatataagcacttagaggagcaatgcctggcacacagtgaatgttacatattagctgagctgttactgttattccttaataattaagttctgataattattcagcctgaaaat

SEQ ID NO: 286874 - DNA, 875 bp, Homo sapiens
ggcggcggaagtgcgcagccgcgcggcattctggggccggaagtggggggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcaagagacctcattggctgtctccagaagctgctgtttggaaaggtggcaaaggatagcagcagcaaatgtgggccaaaggaaaccagtctgcggcagttggtggtgcctgggcgacccagaggtgctgagtaccagctgctgggcttagggacctcgtgtggtctc

SEQ ID NO: 286875 - DNA, 385 bp, Homo sapiens
  misc_feature (380)..(380): n is a, c, g, or t
ttcttccttaaccgcaggcgcctggcggagctgacggtggacgagttcctagcttcgggctttgactccgagtccgaatccgagtccgaaaattctccacaagcggagacacgggaagcacgcgaggctgcccggagtgtttatcgatgccactcccttgtgttacctttcattgaagtttctcccgagtgataggcactgtgcatattaataaacttgattgtttttctcttgtttgtcttttgctactgaagtctgtttgaactatgaatttatgagcgtcgaggagaaattacacttcctaccccactattccattaagagaatgaaaagacaagcccagattggaagaatatcttttctatctgtgcattcgatanacacc

SEQ ID NO: 286876 - DNA, 307 bp, Homo sapiens
tgttctagaggatccgcgaagcacagaggaggacgacaccgagggattctcggagaagagggggctcaccagtctctggcccagctggggccaacctcagtgttgccaggcttctggtgccagcgccttccctccttgaagtgaaggcctactgggattggtaactctgtccccaggcctgtgacctcccagttcctccccagggctcctctccacctgctggaagtcagcggagggaagggtgttgggagcctggccaccctcctgcccccactgtgactttgctggtggaccctgtgggtgggag

SEQ ID NO: 286877 - DNA, 2799 bp, Homo sapiens
taagggctaggtgcgaggcctgggggttaccggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcaagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286878 - DNA, 2816 bp, Homo sapiens
ggcggcggaagtgcgcagccgcgcggcattctggggccggaagtggggggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcaagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286879 - DNA, 2790 bp, Homo sapiens
aacgatccgtttcatccccttgggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcaagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286880 - DNA, 3392 bp, Homo sapiens
taagggctaggtgcgaggcctgggggttaccggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcaagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttgagtggtgggaaggttgccgtcctggctgcaggacgcctctcggaaagagatgttcacgtcccagtgggtgtggactcttctcttcatgatacggatgtgcggaccatcctcctgcttcaagcctgccgccgccacaggtggggccactcccgtcgctgtcaccatcgctggcagagaagctgggagttcgctccttcttcaggttccgggcggcaggcagggcgactgtcctcttgtctgccagccgcaccggttcaccggggaggatattcggcagcccgggcagtcgcagatcggaggatgcacctgcaggatccccttggacataagcgtcttcagacttttcccttccgagcggagggagcggcccgcgagccgcaagcgctgtggcccaagctggggggaggtgcagcggggggcgatctgtccgtgttcaccgaggcctccgcgcgcggcgggggtgtccccgcgcagccctggagctgcagcgccccctcggccgagccggaggctcccgggtgtccgagtcgggtagggggtggggtcggggcccgcgggtcccggcagcgaagggaggggcggcggcacctttgt

SEQ ID NO: 286881 - DNA, 3358 bp, Homo sapiens
taagggctaggtgcgaggcctgggggttaccggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcaagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttgagtggtggctcctggagatttgtgtggccccacccctacccccggcaacctcaacacagaggctgggaagggtcgggggcccctggaagtagagccaaggtcccattctcctgcttgggtgaagtttgaccggcaagggcgtggccccccctccatagggggacgtggccgtcgtgggggacaagggctgctctcctgtgccgagttctcgctccggggcccgcagggttggtggctgcagtggcagagccacggggaagctggccacgtagaaaactcggcccaggcgcctggccacctgggcccggatcttgagggcgggccccagcttcagccccatgttggtcagcaggtgctcctccgtcagcagtggcagggtctccccgtcgatcccctgctccctgaagacctggaagggggagggagggagggtcaggacccgggtgctgctccatcctccagcccagcagagccaagaggagctgtttgtgcagctcacggaaattttttaaaaacagtgatctgttgggtttgagtgtcaggcagaaaacacctggcaa

SEQ ID NO: 286882 - DNA, 3457 bp, Homo sapiens
taagggctaggtgcgaggcctgggggttaccggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcaagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttgagtggtggctcctggagatttgtgtggccccacccctacccccggcaacctcaacacagaggctgggaagggtcgggggcccctggaagtagagccaaggtcccattctcctgcttgggtgaagtttgaccggcaagggcgtggccccccctccatagggggacgtggccgtcgtgggggacaagggctgctctcctgtgccgagttctcgctccggggcccgcagggttggtggctgcagtggcagagccacggggaagctggccacgtagaaaactcggcccaggcgcctggccacctgcagagagatggcctggtgggggctgtcgcacacccacccagagctttctgcccagctgtggtctggagaccctgacctcactccccagcgtctcacctgggcccggatcttgagggcgggccccagcttcagccccatgttggtcagcaggtgctcctccgtcagcagtggcagggtctccccgtcgatcccctgctccctgaagacctggaagggggagggagggagggtcaggacccgggtgctgctccatcctccagcccagcagagccaagaggagctgtttgtgcagctcacggaaattttttaaaaacagtgatctgttgggtttgagtgtcaggcagaaaacacctggcaa

SEQ ID NO: 286883 - DNA, 3237 bp, Homo sapiens
taagggctaggtgcgaggcctgggggttaccggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcaagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttgagtggtggctcctggagatttgtgtggccccacccctacccccggcaacctcaacacagaggctgggaagggtcgggggcccctggaagtagagccaaggtcccattctcctgcttgggtgaagtttgaccggcaagggcgtggccccgtaaacttccttcgggccttaaggcccaggagcctcgcagagaccttccgagcggagggagcggcccgcgagccgcaagcgctgtggcccaagctggggggaggtgcagcggggggcgatctgtccgtgttcaccgaggcctccgcgcgcggcgggggtgtccccgcgcagccctggagctgcagcgccccctcggccgagccggaggctcccgggtgtccgagtcgggtagggggtggggtcggggcccgcgggtcccggcagcgaagggaggggcggcggcacctttgt

SEQ ID NO: 286884 - DNA, 2756 bp, Homo sapiens
aacgatccgtttcatccccttgggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggaccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcaagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286885 - DNA, 2730 bp, Homo sapiens
gtagaggttgttgggtaggagacgtgagtctgccaaaaacgtacctcctggcaatcctgtcttgctagttggtaatccttgtgaagggagtagactgaccctgtaggccactccccgccccctctacttccacttcccactggggtcgctgacttctgcctcctcaccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcaagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286886 - DNA, 3408 bp, Homo sapiens
taagggctaggtgcgaggcctgggggttaccggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcaagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttgagtggtggctcctggagatttgtgtggccccacccctacccccggcaacctcaacacagaggctgggaagggtcgggggcccctggaagtagagccaaggtcccattctcctgcttgggtgaagtttgaccggcaagggcgtggccccccctccatagggggacgtggccgtcgtgggggacaagggctgctctcctgtgccgagttctcgctccggggcccgcagggttggtggctgcagtggcagagccacggggaagctggccacgtagaaaactcggcccaggcgcctggccacctgcagagagatggcctggtgggggctgtcgcacacccacccagagctttctgcccagctgtggtctggagaccctgacctcactccccagcgtctcacctgggcccggatcttgagggcgggccccagcttcagccccatgttggtcagcaggtgctcctccgtcagcagtggcagggtctccccgtcgatcccctgctccctgaagacctggaagggggagggagggagggtcaggacccgggtgctgctccatcctccagcccagcagagccaagaggagctgtttgtgcagctcacggaaattttttaaaaacagtgatctgttgggtttgagtgtcaggcagaaaacacctggcaa

SEQ ID NO: 286887 - DNA, 2456 bp, Homo sapiens
aacttaggctaggtacgaggctgggtgttgaatcggccgaggccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcaagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286888 - DNA, 2697 bp, Homo sapiens
taagggctaggtgcgaggcctgggggttaccggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcaagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccggctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286889 - DNA, 2708 bp, Homo sapiens
taagggctaggtgcgaggcctgggggttaccggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcaagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286890 - DNA, 2280 bp, Homo sapiens
taagggctaggtgcgaggcctgggggttaccggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcaagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggtccactttggaggatgggaacccctaactccaaagcgccggttgccccctgggaagcttgaaccacttggccccagggg

SEQ ID NO: 286891 - DNA, 2074 bp, Homo sapiens
cccagccaagggtgggtggtctctctgcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286892 - DNA, 2127 bp, Homo sapiens
taagggctaggtgcgaggcctgggggttaccggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcaagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaagtggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286893 - DNA, 2213 bp, Homo sapiens
aacgatccgtttcatccccttgggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286894 - DNA, 2106 bp, Homo sapiens
aacgatccgtttcatccccttgggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggagcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286895 - DNA, 1747 bp, Homo sapiens
agaatataaggctaggtacgaactggtgtgaatcggcgaggccacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286896 - DNA, 1693 bp, Homo sapiens
  misc_feature (15)..(15): n is a, c, g, or t
tacgccaagcttggnacgtagggtgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286897 - DNA, 1841 bp, Homo sapiens
ggcggcggaagtgcgcagccgcgcggcattctggggccggaagtggggggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcaagagacctcattggctgtctccagaagctgctgtttggaaaggtggcaaaggatagcagcaggatgctgcagccgtccagcagcccgctctgggggaagcttcgtgtggacatcaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286898 - DNA, 1462 bp, Homo sapiens
gcgggcggttaatcggacgaggcctgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286899 - DNA, 1695 bp, Homo sapiens
aacgatccgtttcatccccttgggggtgcacgcttcgggttggtgtcatggcagctgcggggagccgcaagagtgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286900 - DNA, 770 bp, Homo sapiens
aacgatccgtttcatccccttgggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286901 - DNA, 831 bp, Homo sapiens
aacgatccgtttcatccccttgggggtgcacgcttcgggttggtgtcatggcagctgcggggagccgcaagaggcgcctggcggagctgacggtggacgagttcctagcttcgggctttgactccgagtccgaatccgagtccggataagccgggcgggagcccctcggccaggttagtggggacatgcgtgagcagaacctcttgctcgtcctgtcccaccccggttgggttgctgacctcgcctggggtctcagggccaaggcctaaggatcgccgacctctgccccccagtcctttcagcttaacttactctttcatccgatgtttactgagctcctgttccgtgccaaactctgtcctaggcagggagcgtatgttggtgagttgtgcaaaaatctcttcccgatctaggagaactctcacgttcttgggtgaaatcaccgcctgcagttcggtagaagagagataagtgctggggagggaaaggaaggacagaggggctgaagagagagttgcaggggagccgagttgctctgttagaaggagcggaggctgtgctcggtggctcacgcctgtaatgccagcactttgggaggccgaggcgggcagattacctgaggtcaggaattcgagaccagcctgaccaacacggaaaaatcatgtctctactaaaaatataaaaattagccgggcgtggtgggcacctgtaatcccaactactcgggaggctgaggcaggagaatcgcttgaacttgggaggtggaggttgcagtgagccgagatggcaccattgcattccagcctgggtgagagagtgagactccatctc

SEQ ID NO: 286902 - DNA, 561 bp, Homo sapiens
gtctcactgtgttgttcaggctggtctcaaactcctgggcttggagtttgatcctcctgccttggcctcccaaagtgcagtgagtactggcatgagtctccacacctgccctctgattttcttttctttgtgcagcaaatgtgggccaaaggaaaccagtctgcggcagttggtggtgcctgggcgacccagaggtgctgagtaccagctgctgggcttagggacctcgtgtggtctcacggtggggatgtgatcaaggggacctagaaaaggtttatgtctgagagggagttggaggctgggacttccggggactcttagggcggtggccaaccctgggcagggcagacaggagttcaaggccactgaaggaggagctaatgcacttgagagggtcctcctaagcccctgtgtctgtccagctgtaaggggccctgagcttttttgagtggagagacggggggtctctgcagagtcgtagaggctatgctggccagggcacgcgccaacatgctgagcagcctcgcgtccgagccgtggggcctcccagccaagggtggg

SEQ ID NO: 286903 - DNA, 843 bp, Homo sapiens
tcgacttggagagggggtaggtgttggagaactggccagaaccaggcgtttccagggaggggaagccccaggctgcactaggttggggaggccatgccccctcaggcctgatgggctggaggctccgggcaggtggagtggctggactgacctcgtcacccaggccagtatgtgggcaccaggggcccgtgaggagaagcaggaagggctctgcctttgaccttggacatgggatggacaacttggaggatggctttgtgatttgggaacagaggggactagaaattggccacatggggccctggtggtgggtctggcgatgcctggccctgctgtggccgccagcccctgccctctctcacctgagcccctggttctttggccttccagctggaagacctgaacttccctgagatcaaacgaaggaagatggctgacaggaaggatgaggacaggaagcaatttaaagacctctttgacctgaacagctctgaagaggacgacaccgagggattctcggagagaggaggtggggcctgcgtggtgctcccaggggaagggtgggcctggagggctctgctggacttcccagagccacgagggccacctgtacccatcctgcagggggctcaccagtctctggcccagctggggccaacctcagtgttgccaggcttctggtgccagcgccttccctccttgaagtgaaggcctactgggattggtaactctgtccccaggcctgtgacctcccagttcctccccagggctcctctccacctgctggaagtcagcggagggaagggtgttgggagcctggccaccctcctgcccccactgtga

SEQ ID NO: 286904 - DNA, 587 bp, Homo sapiens
agaactcggcatacatctgcagccgccgccagagggtttccttcggcgtctctgagcagcaggcagtggttagtgggccctgggggtagtgccacctgagggcacctgccagggtatagccccagctacatgtgggggtttgcccagggtgaggcatgaccctgaactcccccaaccccccaggaagcctgggagaagctgacccgggaagaggggacacccttgaccttgtactacagccactggcgcaagctgcgtgaccgggagatccagctggagatcagtggcaaagagcgggtgcggctcggcgaggggacctgggggtgtgttgtgacttcctgggtttcagatctagcgcactatgacttgagaccagggcgagggtttggaaacagtgccaggcggccagggccgtgcccggatgattcgacttggagagggggtaggtgttggagaactggccagaaccaggcgtttccagggaggggaagccccaggctgcactaggttggggaggccatgccccctcaggcctgatgggctggaggctccgggcaggtggagtggctggactgacctcgtcaccc

SEQ ID NO: 286905 - DNA, 2455 bp, Homo sapiens
taagggctaggtgcgaggcctgggggttaccggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcaagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagaggaggtggggcctgcgtggtgctcccaggggaagggtgggcctggagggctctgctggacttcccagagccacgagggccacctgtacccatcctgcagggggctcaccagtctctggcccagctggggccaacctcagtgttgccaggcttctggtgccagcgccttccctccttgaagtgaaggcctactgggattggtaactctgtccccaggcctgtgacctcccagttcctccccagggctcctctccacctgctggaagtcagcggagggaagggtgttgggagcctggccaccctcctgcccccactgtgactttgctggtggaccctgtgggtgggag

SEQ ID NO: 286906 - DNA, 1956 bp, Homo sapiens
cagcgcgttggtacctgccctccgggatgtttttacggggactatcaggtcgaagcaccaacgacgtcgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286907 - DNA, 1334 bp, Homo sapiens
taagggctaggtgcgaggcctgggggttaccggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcaagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaagcgaaaaaggcacctaccggttggtcaatggcatatttgcttgctcttccgtgtgccggccgacatgtggcacagaactcaacctgt

SEQ ID NO: 286908 - DNA, 1743 bp, Homo sapiens
aacgatccgtttcatccccttgggggtgcacgcttcgggttggtgtcatggcagctgcggggagccgcaagagtgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286909 - DNA, 2000 bp, Homo sapiens
aacgatccgtttcatccccttgggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggagcgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttga

SEQ ID NO: 286910 - DNA, 1551 bp, Homo sapiens
taagggctaggtgcgaggcctgggggttaccggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcaagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtggtcgtatggagcactggggaggagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccaggtaagcatgcctacctgggcgtatggcaagactccctctctataaaaagttaaaagaatgagttgaatgtggtggcacatgcctgtagtcccggctacttgagaggctagggcgggagaatcagttgagctcaggaggtcaaggctgcagtgagccaagaccatgccactgcactccagcctgggcaacaagagtgaagcttcatttcaaacaaacaaacaaacaatcaaacaagtaaacaaacagaccccaaactattattttacttctggggcccagaattccaaaatcagcttcactgggataacgtcaggtgcagcagggctggtactccggagcttgtagagg

SEQ ID NO: 286911 - DNA, 884 bp, Homo sapiens
aacgatccgtttcatccccttgggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccaggttagtggggacatgcgtgagcagaacctcttgctcgtcctgtcccaccccggttgggttgctgacctcgcctggggtctcagggccaaggcctaaggatcgccgacctctgccccccagtcctttcagcttaacttactctttcatccgatgtttactgagctcctgttccgtgccaaactctgtcctaggcagggagcgtatgttggtgagttgtgcaaaaatctcttcccgatctaggagaactctcacgttcttgggtgaaatcaccgcctgcagttcggtagaagagagataagtgctggggagggaaaggaaggacagaggggctgaagagagagttgcaggggagccgagttgctctgttagaaggagcggaggctgtgctcggtggctcacgcctgtaatgccagcactttgggaggccgaggcgggcagattacctgaggtcaggaattcgagaccagcctgaccaacacggaaaaatcatgtctctactaaaaatataaaaattagccgggcgtggtgggcacctgtaatcccaactactcgggaggctgaggcaggagaatcgcttgaacttgggaggtggaggttgcagtgagccgagatggcaccattgcattccagcctgggtgagagagtgagactccatctc

SEQ ID NO: 286912 - DNA, 921 bp, Homo sapiens
acgcgtaacgccctctgcgtgcgccggcgccctatgaagatccggcgcagctaaagtcagtggaaggtagaaagacgccacagccgcctttcgacaactttttgttacaaaagtggagatctacacggaggcgacggcctaggtcgctctgacaggacccaacgaccctcctgacgcgtccacccgtcctcgctagcagggtcccccagcgggctctcgacctgcgccaccagagttccactctttttgtcgacaataatatggcgcccaaacacgtggggcctcagagaagactctggatccggaaggagtatcccaaaaccagagctaaggtaccagctggagcccactgaagcctcaccgagtttgggcttctcctcctgtggaactggaaaccaaaatcatggtattttgaaaaccagaggtatgaatctccctcgtttggcatcccactgggcctggacctgtttcactgctaatgttctgctgccaaaactatacaagctgcctggactattgcagaagaggaagatgaaacactgaattaggagatctgggaaactgcagacacactttctgacatgttcaaatcaggaaaaaaagggtttgaaatctttcttctataatacttcatgaatttttctaaaatactgttcaattttaatgtatttgtttattctgttgccaatgtttaagtctttaatcactttaaacaataggaagtaaaaattaaacagcttcataactttaagctttcatattagcagaaactctattttctaaaaattgttgccagatcattgaattctaaatacttgcctattaaatgtctgtgaaatgaatcaatttctcacataccacattacttccttctatctcctaccttcagctagtggggcaatccaatagcctactagaagt

SEQ ID NO: 286913 - DNA, 1035 bp, Homo sapiens
acgcgtaacgccctctgcgtgcgccggcgccctatgaagatccggcgcagctaaagtcagtggaaggtagaaagacgccacagccgcctttcgacaactttttgttacaaaagtggagatctacacggaggcgacggcctaggtcgctctgacaggacccaacgaccctcctgacgcgtccacccgtcctcgctagcagggtcccccagcgggctctcgacctgcgccaccagagttccactctttttgtcgacaataatatggcgcccaaacacgtggggcctcagagaagactctggatccggaaggagtatcccaaaaccagagctaaggtaccagctggagcccactgaagcctcaccgagtttgggcttctcctcctgtggaactggaaaccaaaatcatggtattttgaaaaccagaggtatgaatctccctcgtttggcatcccactgggcctggacctgtttcactgctaatgttctgctgccaaaactatacaagctgcctggactattgcagaagaggtgggtgcataagattgtaaggaccggctttcagggaaaaaattagcttaaggtcaaaccctccaaatcaagaaagggggtacaaaaatgcctaaacagcaggtaaaacaagtttagttgccttctaagctattatgtgtcacttttgcatccaccccaaccataaaaattttctgcttactatagaattaaaggaaattctttactaacaggataaaaatattttgtaacaaagcctcctgggtataatactaccaatcatgagttgtgaagatcgatcgatctatctatctatctatctatctatctatctatgtaactatatttttcagaagaatgcttatgtttggtatataaggctaactgttacaagtctgtaacaaaaaccaagctcacagtagctcaacacatagaagttaaaaataagtccgtcttttaacttttgttttgttttgttttgttgttggcttttttacttaaaataataattttacgaagtaacaagtgc

SEQ ID NO: 286914 - DNA, 469 bp, Homo sapiens
gggacctcccccaggggaaggggactcatccaggagagcagggccccagccatgtgccagtgttctgtgctaacatctccagctgctgggtccccctgaactgatggtgaactgccagagccagggagcccacagatgccaactccagctcccttgcctgagagcagatactgttctgaaaactccctggaacaactcacactcgccgcagtcctttgaggtaaatatgattatcgtcacccccatcgtgtagatgaagaaaccgaagtacagaggggttaagtgacttgcccaaggtcacacagccagcaactggtagagctgggatttgaaccccggtagctgcctccaggacctaccgctctgttgctttctcatgtgctaagtggcccaaaagaagagttaaggtgggtggggcaggggagaaaggcaggcagggcctggagcccagcaggagtcactagctaga

SEQ ID NO: 286915 - DNA, 603 bp, Homo sapiens
ccatctgggagcagggccaagagaagctggcagcagttacacagcgcaaaataaaaggccttgggctggactcaggcggaaagaaagtgctggaggaaatgaaagaacaaagcgggctgtctgtgtgcccacgccgggccggtcactaccttttctgcctgacaagtgtacataaaacaattcccgaacagcacggagcatcagacacaactagagctgctgggtccccctgaactgatggtgaactgccagagccagggagcccacagatgccaactccagctcccttgcctgagagcagatactgttctgaaaactccctggaacaactcacactcgccgcagtcctttgaggtaaatatgattatcgtcacccccatcgtgtagatgaagaaaccgaagtacagaggggttaagtgacttgcccaaggtcacacagccagcaactggtagagctgggatttgaaccccggtagctgcctccaggacctaccgctctgttgctttctcatgtgctaagtggcccaaaagaagagttaaggtgggtggggcaggggagaaaggcaggcagggcctggagcccagcaggagtcactagctaga

SEQ ID NO: 286916 - DNA, 377 bp, Homo sapiens
caggaaaactgccttgggtgccatggcgcagcctgcccacacttcaggcacagagcacagaagattctgtggtttccacacctgggaagagaaaagaaaaaccttccagtgttcaggtagccacaacttgaccatggggaccccttgaactggcacgacctcccgtccgcacccaagtccccaccagcctgtccctctgatggttctgggctgggtgtggcagggaaagggcagaagtgagactttgacctggtgggtgcacacgcctaggtgtaaatctagctccaacatcttacatgagaatgaattgaattcagattctttaatggctcaccctggagttttatccctcctggtaataatttcatgaccaacac

SEQ ID NO: 286917 - DNA, 454 bp, Homo sapiens
tcaagtaattattcagcacaaattcatgaacatgtacctaaagcatagatataaaaatgtttatactcccaaagcaaaagcaacccaaagtctgtcaattatagaataaataagtagtgttttagtcacacaataaatactgtaaaacaattaaaatgaacaatctacaactgtgttcaaccacatggatgaattttataaaccaaaattttagtgaaaggagccaaatacaaaacaacacatactctatgattcatttttgtatagttgaaaacagacaaaacaagtctattgtgttagaagtcagtgtagtgagtaacatttgctttggagtactggggtgctgatttggacagtgcaggaggaggtggtggtgatgctcaatttcttgagcagattgattgttaccttggttagttcaatttgtgctcatgatttatatacttttctctta

SEQ ID NO: 286918 - DNA, 1352 bp, Homo sapiens
ccccccaggagcaatgggcccaggccccgcctcccgcacacacccaccctgatgtagtcggctccgggcccgctgtcatcctcgttgagcaggatgactcaagggtagcatcaactgggaagggaggtgccgctcagttctccagggcacagctcgtgggcctcaccctgcctctttgcccgcagaccctgtggtgagcagagatggagggtccagggtatgcaagggggagcctcaggtcagcggtggcagatgctcggcctgccccccacctcccccaggcccgacgggtgacgccctggcctccgccctcacagggaaggatgttcttgtagtgattcttgggcttgttctccacactctgcccctccttccgagggtacaggaaccggcattcctgctgctgcagcatctggaggtgatggagccttcagctcacagccccggccccttcccagagcccgagatggccacccccagcccgtcccgtgtgggcggaagagtacctaggtgccgaggcaagagactgaaggcacaaactgtttcagtataataaagaaaatagaataagaatagtcataatacaaattagatacagcgatgatcatgaacaattatccatcattattataaacattattaatcattagcttttaatattactctgttgcattaataatataacctaggaataaccggcaggtatagggtcaggtgctgaagggacattgtgagaagtgaatagaaggcaagaggggagccttctgtcatgcccgcataagggccgcttgagggccccttggtcaagcggtaacgccagtgtctgggaaggcacccgttactgagcagaccgggaaagggagtctcctttccttggaggagtcagggaacgctctgctccaccagcttcttgtgggaggctggatgttacccaggcctgcctgcagtcatccggaggcctgaacccctccctgtggtgcttcaatggtcacgttccttgtccactttcatgctccttccgtactcctggttcctctttgaagttcgtagtagatagcggtagaagaaatagtgaaagtcttaaagtctttgatcttataagttcatagaagaaaacgctgatgcctgccgccttctctctctgcttcagctacctaagagggaagggcccgctgtcctgtgatcaggtgacttgcttcaccttgtcaatcacttagaagactgaccctccttatcctgcccccttgtcttgtatgcaataaatatcagcgagcccagccgttcagggccactaccggtctccgtgtctttgtggtagtggtccccggggcccagctgttttctctttatct

SEQ ID NO: 286919 - DNA, 1371 bp, Homo sapiens
ccccccaggagcaatgggcccaggccccgcctcccgcacacacccaccctgatgtagtcggctccgggcccgctgtcatcctcgttgagcaggatgactcaagggtagcatcaactgggaagggaggtgccgctcagttctccagggcacagctcgtgggcctcaccctgcctctttgcccgcagaccctgtggtgagcagagatggagggtccagggtatgcaagggggagcctcaggtcagcggtggcagatgctcggcctgccccccacctcccccaggcccgacgggtgacgccctggcctccgccctcacagggaaggatgttcttgtagtgattcttgggcttgttctccacactctgcccctccttccgagggtacaggaaccggcattcctgctgctgcagcatctggaggtgatggagccttcagctcacagccccggccccttcccagagcccgagatggccacccccagcccgtcccgtgtgggcggaagagtacctaggtgccgaggcaagagactgaaggcacaaactgtttcagtataataaagaaaatagaataagaatagtcataatacaaattagatacagcgatgatcatgaacaattatccatcattattataaacattattaatcattagcttttaatattactctgttgcattaataatataacctaggaataaccggcaggtatagggtcaggtgctgaagggacattgtgagaagtgaatagaaggcaagaggggagccttctgtcatgcccgcataagggccgcttgagggccccttggtcaagcggtaacgccagtgtctgggaaggcacccgttactgagcagaccgggaaagggagtctcctttccttggaggagtcagggaacgctctgctccaccagcttcttgtgggaggctggatgttacccaggcctgcctgcagtcatccggaggcctgaacccctccctgtggtgcttcaatggtcacgttccttgtccactttcatgctccttccgtactcctggttcctctttgaagttcgtagtagatagcggtagaagaaatagtgaaagtcttaaagtctttgatcttataagttcatagaagaaaacgctgatgcctgccgccttctctctctgcttcagctctgacggacagcgtgaagccccccgggctgctctcactgggcctggcaaggaagtccccacgctgacctctggataggaacagcttctccgcctccaccctgctgatgttggggtgaaaccacctgtaatcccagctacacgggaggctgaggcaggagaatcgcttgaacccgggaggcggaggttgcggtgagccgagatctcgccactgcactcca

SEQ ID NO: 286920 - DNA, 1226 bp, Homo sapiens
ccccccaggagcaatgggcccaggccccgcctcccgcacacacccaccctgatgtagtcggctccgggcccgctgtcatcctcgttgagcaggatgactcaagggtagcatcaactgggaagggaggtgccgctcagttctccagggcacagctcgtgggcctcaccctgcctctttgcccgcagaccctgtggtgagcagagatggagggtccagggtatgcaagggggagcctcaggtcagcggtggcagatgctcggcctgccccccacctcccccaggcccgacgggtgacgccctggcctccgccctcacagggaaggatgttcttgtagtgattcttgggcttgttctccacactctgcccctccttccgagggtacaggaaccggcattcctgctgctgcagcatctggaggtgatggagccttcagctcacagccccggccccttcccagagcccgagatggccacccccagcccgtcccgtgtgggcggaagagtacctaggtgccgaggcaagagactgaaggcacaaactgtttcagtataataaagaaaatagaataagaatagtcataatacaaattagatacagcgatgatcatgaacaattatccatcattattataaacattattaatcattagcttttaatattactctgttgcattaataatataacctaggaataaccggcaggtatagggtcaggtgctgaagggacattgtgagaagtgaatagaaggcaagaggggagccttctgtcatgcccgcataagggccgcttgagggccccttggtcaagcggtaacgccagtgtctgggaaggcacccgttactgagcagaccgggaaagggagtctcctttccttggaggagtcagggaacgctctgctccaccagcttcttgtgggaggctggatgttacccaggcctgcctgcagtcatccggaggcctgaacccctccctgtggtgcttcaatggtcacgttccttgtccactttcatgctccttccgtactcctggttcctctttgaagttcgtagtagatagcggtagaagaaatagtgaaagtcttaaagtctttgatcttataagttcatagaagaaaacgctgatgcctgccgccttctctctctgcttcagctctgcttgaggtgcacaaccgcccccaccttccccatcaatgggctcttcctgctacaccgggtctccgagggtg

SEQ ID NO: 286921 - DNA, 268 bp, Homo sapiens
agtccggccagccgaagtactggaagtgctgcaccgtacgctgtggctcctcctgagcggggcaagcgacctaagagggaagggcccgctgtcctgtgatcaggtgacttgcttcaccttgtcaatcacttagaagactgaccctccttatcctgcccccttgtcttgtatgcaataaatatcagcgagcccagccgttcagggccactaccggtctccgtgtctttgtggtagtggtccccggggcccagctgttttctctttatct

SEQ ID NO: 286922 - DNA, 446 bp, Homo sapiens
ctgttatcccctcgtcccgttgtcccctcgggacgtctggcacagcttccccgactaattccggcccctcacctcaactgtgctggccgggaggagagcagagacgcagtcctgcccagtgtagaccgtggaccccgcagccgaatcccttgggaagctgcttaaagtgcatcctaccaatgcagctcctttagggccatggagccccaatactctgcattcctaacacgcgctgtggggcaggcgcagtccaggtacacctactttctcctgcctctgccacccctgagacagcaagaccagccccctcttcctccttcccagtctactcaacatgaagacgacagaaggggaagacctttatgaggattcacttccacttaaggaataatgaatatgttttatcttccttaaaaaaaaaataaaagatgtggaggatggcttga

SEQ ID NO: 286923 - DNA, 476 bp, Homo sapiens
tagggccatggagccccaatactctgcattcctaacacgcgctgtggggcaggcgcagtccaggtaaggacatgggccaggctgctccctgataatacccgtgagcccatcccccgccacgacccgggcgacccgcggggaggaggcttccctgatcctcccacctcacctcgtccttgtccactttgctgaatcccttagaaacctggacttgaactgagccttgctcccctcccctagcccaaagactgggaaccttgagaggcccgcggtgctgggtacgaggagggggcgggaaagccccggggagctggactgaagtggactggggctgggggcagctggcatctggttttcacactcaccatgtacaccattcaataaacctttatcgccccgagtagaagaatgaataaaactagacccatttcgatctgcaattcattacctaagtcgagggaaaactattgggggcg

SEQ ID NO: 286924 - DNA, 2436 bp, Homo sapiens
aataagatgcgatactagctcacagcctgggctacagcttaaatgcagaaggctaaaaatttaaccagcttcttggggctccatttttaatactaattcattcagaaaatgcaacaggagctggtgctacacaaaatcagaagtctttaggaactgcactgggttgctctgttagtcaagaaaactaacagtaaaaatctgcccttaagtattttaagttaaaatccatgttcagtggtgcataactctggggtaccaacccagtatttactttgagaaaagtatccaatcttgctcaaaggtatcaaatctgttgtaggtgctgaagtgggatgagcttctgtctaagctaggttcctctagttctgtagtagacagccaggttcctctatttttacaaaagaataatgtgttctttgttgtctgcctgtagatttaatatctaaaagattcaagtctccctaattgacaatccatgcccatgggaccagttcataacagaattaagctgtgaagtgactcaatctgtcacctccccaaagctcagctggtactgctattttttcagaacaagacattcattttcctctaaacctactaaacttgatccatgtatatgttaaattgccaaaaaaggaatttacatgaactgtattaggcttaaactgaattataagatatcaggtccttggtttttaacagaaattcttttttttttttttttttttttttttttcctgagacagggtctacagggtcttgctctgtcgcccaggctggagtgcagtggcacaattatagctcactgcaacctccaacttctaggctcaagcaatccaactgcctcagcctcccgagtaataaattccattttaaagttgtttgccaatttcattgtctctgcaaactaatttatcctttgaatccaatgatgagaactgcaatcccaaggtttctctttttgctttggctgccaggaatttcagagctaaatgtaggcttagattcttaaagtgcctggcacatctctctcttcctgtaatctagtttctgatctttctcttccatttttaactttctaatctgcactgtccagtatggtagccactagtcacgtacatttgacaggtaggctagtccaaattgggatgtgctgtaagtgtaaaatatctcagtaagttttaatattgattacatattgaatgattttttgatatattgggtaaaattaagttattaaaattaatttcaccacttcattttacttattttggctactagaaaattttaaattatatatatggcttgcatttgtgacattatatttctagtggatggcactattctgcaaatcatctgttttatgactgtgttattattgtaaacctgaaatccttttggaaagcaggtgaagtaatacaaataataatacaaaggtggcagcagtggatggaatgagaaaggggaggtcgactgggacaagttcttgtccttatccttgtcaatttgtcttttgcttgtgtgattcacatacaaaccccttggtaaagtgtgttgtcagctctcttcatcccaggtgagtagtattctcatggctctcccttgtctccagaaaaacctcagctttactttagctaacaaattggaaacgatctgataagacaattcacaccacattgcaagtgactgataacaacattgtgttcatccctgtcagggagtatttccattttaaccggaaacaatccctgaacccacaggaatgaatgcctaatggtggagtttcagccatcagtgacaggtgagtgagaggtagactctggttttgtgtgtgtgtatgtttatatgtgtatggctacattcaggatagggctgaaagtagggtatttggatggaaaggtaatggggctggcagagaagccaagcggagaaggtggcaaatccccagctgggccagactgagaggggtggtgagacaccaaccagatgcggtgcaggccctcaaggatttgttaagcaatagaatagcccagttgatgtcaccagagggtgggtatcaagacagtctccacagtaactactgtagagtaacagaaaaggtctcagagtaggattcaggagattatgactgcagtctacaactgactcactggcttaactctgggcaagtccttttaccccttgggtttcagtttcttcatctggcattttccagacaaagaaatgggtgttcgattctcaaatgagttctaagagatgtgaaggtgctctgagaagtagaaagtgctctatacatgcaaggatgcaaggaagagtgatttcatatcttaaaatggaaatacagccaggcaggcctagagtagtagaggacagaaagcagggatggaggactatggggaaacctgaaagccggtgtacttgaaacactggtctttc

SEQ ID NO: 286925 - DNA, 917 bp, Homo sapiens
ctcggttatggaggaggccttccgctcgcagcggcctctccagcaccccttttaggcctgagcacccgcaggggtgcccaggccgcacgccaaacgcgggcccgcgccggttacctggctgcgcgctcccgctctgcctcgcgattctccggaatcgtacctcttcgtgggctcgcgccagcgctgtgagcgcacaattagtttaaactatggccccgccccctcgcgctgccctctgattggcctctgtcggcggggcccgcttaaggacccgggaaaaggaagtttgagggccactgggaaagagaaggggtatcaccgcttccggaccccggcctgtacttgaaggcaaagagaactacaaatcccagcgtcacccgcggccttgaagccccgcccctgacaaactgaaggtcccggtaagcatcgcgtcagtacttatggcgcctgccgggttgtggtgacgaaagcagttgccatggagttgctctgagtaaccctgaggcagtgggacgccaagactggagaggaagcgactgcggggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagcagcaaatctgaaaggaaacagggggctatcacagtagttgatcatctttaaaagaagccaggctacagcaggaaagtcaagtggaagaaaactgggaagccagtctatcagccaatagttttattctcctgtttttacctgaagagaggagga

SEQ ID NO: 286926 - DNA, 2634 bp, Homo sapiens
ctcggttatggaggaggccttccgctcgcagcggcctctccagcaccccttttaggcctgagcacccgcaggggtgcccaggccgcacgccaaacgcgggcccgcgccggttacctggctgcgcgctcccgctctgcctcgcgattctccggaatcgtacctcttcgtgggctcgcgccagcgctgtgagcgcacaattagtttaaactatggccccgccccctcgcgctgccctctgattggcctctgtcggcggggcccgcttaaggacccgggaaaaggaagtttgagggccactgggaaagagaaggggtatcaccgcttccggaccccggcctgtacttgaaggcaaagagaactacaaatcccagcgtcacccgcggccttgaagccccgcccctgacaaactgaaggtcccggtaagcatcgcgtcagtacttatggcgcctgccgggttgtggtgacgaaagcagttgccatggagttgctctgagtaaccctgaggcagtgggacgccaagactggagaggaagcgactgcggggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttacaccttgtagagatgttctctaactcaggcaactgcaagtagctctagccttttcttttctttttttttttttgagacggagtctcactctgtcacacaggctggagtgcagtggcacgatcttggctcactgcaacctcagcctcccaggttcaagagattctcctgcctcagcctccccagtagctgtgattaaagggcgcctgccaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaattttttttttgagacggagtctcgctctgtcgcccaggctggagtgcagtggcacgatctcggctcactgcaaactccgccttccaggttcacgccattctcctgcctcagcctcccaagtagctgggactataggcacctactaccacgcctggctaattttttgtatttttagtagagacggggtttcaccatgttagccaggatggtctccatctcctgaccttgtgatccacccacctcggcttcccccagctaattttttatattttagtagagacaaggtttcgccatgttggccaggctggtcttgaactcctgacctcaggtgatccgtctgctttggcctcccaaagtgctgggattagaagcgtgagccaccacgcccagcctttttttgtatttttagtagagatggggtttcgccatgttggccaggctggtctcaaactcctgacctcaggtgatctgcccacctcagcctcccaaagtgctaggattacaggataagccactgcacctggccagctctagtcttattttgctgaaaaagggaggcaattgagggaaaggcctgctggcctgggacactggagacgtgggtttaccacacagccttgggaaatttatctaactctctgggcccctttgtacttttcagcttagagatttgggggttaaagtagatcagtaatttccaaactcttcacagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgcttaaaaa

SEQ ID NO: 286927 - DNA, 3809 bp, Homo sapiens
aataagatgcgatactagctcacagcctgggctacagcttaaatgcagaaggctaaaaatttaaccagcttcttggggctccatttttaatactaattcattcagaaaatgcaacaggagctggtgctacacaaaatcagaagtctttaggaactgcactgggttgctctgttagtcaagaaaactaacagtaaaaatctgcccttaagtattttaagttaaaatccatgttcagtggtgcataactctggggtaccaacccagtatttactttgagaaaagtatccaatcttgctcaaaggtatcaaatctgttgtaggtgctgaagtgggatgagcttctgtctaagctaggttcctctagttctgtagtagacagccaggttcctctatttttacaaaagaataatgtgttctttgttgtctgcctgtagatttaatatctaaaagattcaagtctccctaattgacaatccatgcccatgggaccagttcataacagaattaagctgtgaagtgactcaatctgtcacctccccaaagctcagctggtactgctattttttcagaacaagacattcattttcctctaaacctactaaacttgatccatgtatatgttaaattgccaaaaaaggaatttacatgaactgtattaggcttaaactgaattataagatatcaggtccttggtttttaacagaaattcttttttttttttttttttttttttttttcctgagacagggtctacagggtcttgctctgtcgcccaggctggagtgcagtggcacaattatagctcactgcaacctccaacttctaggctcaagcaatccaactgcctcagcctcccgagtaataaattccattttaaagttgtttgccaatttcattgtctctgcaaactaatttatcctttgaatccaatgatgagaactgcaatcccaaggtttctctttttgctttggctgccaggaatttcagagctaaatgtaggcttagattcttaaagtgcctggcacatctctctcttcctgtaatctagtttctgatctttctcttccatttttaactttctaatctgcactgtccagtatggtagccactagtcacgtacatttgacaggtaggctagtccaaattgggatgtgctgtaagtgtaaaatatctcagtaagttttaatattgattacatattgaatgattttttgatatattgggtaaaattaagttattaaaattaatttcaccacttcattttacttattttggctactagaaaattttaaattatatatatggcttgcatttgtgacattatatttctagtggatggcactattctgcaaatcatctgttttatgactgtgttattattgtaaacctgaaatccttttggaaagcaggtgaagtaatacaaataataatacaaaggtggcagcagtggatggaatgagaaaggggaggtcgactgggacaagttcttgtccttatccttgtcaatttgtcttttgcttgtgtgattcacatacaaaccccttggtaaagtgtgttgtcagctctcttcatcccaggtgagtagtattctcatggctctcccttgtctccagaaaaacctcagctttactttagctaacaaattggaaacgatctgataagacaattcacaccacattgcaagtgactgataacaacattgtgttcatccctgtcagggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttacaccttgtagagatgttctctaactcaggcaactgcaagtagctctagccttttcttttctttttttttttttgagacggagtctcactctgtcacacaggctggagtgcagtggcacgatcttggctcactgcaacctcagcctcccaggttcaagagattctcctgcctcagcctccccagtagctgtgattaaagggcgcctgccaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaattttttttttgagacggagtctcgctctgtcgcccaggctggagtgcagtggcacgatctcggctcactgcaaactccgccttccaggttcacgccattctcctgcctcagcctcccaagtagctgggactataggcacctactaccacgcctggctaattttttgtatttttagtagagacggggtttcaccatgttagccaggatggtctccatctcctgaccttgtgatccacccacctcggcttcccccagctaattttttatattttagtagagacaaggtttcgccatgttggccaggctggtcttgaactcctgacctcaggtgatccgtctgctttggcctcccaaagtgctgggattagaagcgtgagccaccacgcccagcctttttttgtatttttagtagagatggggtttcgccatgttggccaggctggtctcaaactcctgacctcaggtgatctgcccacctcagcctcccaaagtgctaggattacaggataagccactgcacctggccagctctagtcttattttgctgaaaaagggaggcaattgagggaaaggcctgctggcctgggacactggagacgtgggtttaccacacagccttgggaaatttatctaactctctgggcccctttgtacttttcagcttagagatttgggggttaaagtagatcagtaatttccaaactcttcacagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgcttaaaaa

SEQ ID NO: 286928 - DNA, 2636 bp, Homo sapiens
ctcggttatggaggaggccttccgctcgcagcggcctctccagcaccccttttaggcctgagcacccgcaggggtgcccaggccgcacgccaaacgcgggcccgcgccggttacctggctgcgcgctcccgctctgcctcgcgattctccggaatcgtacctcttcgtgggctcgcgccagcgctgtgagcgcacaattagtttaaactatggccccgccccctcgcgctgccctctgattggcctctgtcggcggggcccgcttaaggacccgggaaaaggaagtttgagggccactgggaaagagaaggggtatcaccgcttccggaccccggcctgtacttgaaggcaaagagaactacaaatcccagcgtcacccgcggccttgaagccccgcccctgacaaactgaaggtcccggtaagcatcgcgtcagtacttatggcgcctgccgggttgtggtgacgaaagcagttgccatggagttgctctgagtaaccctgaggcagtgggacgccaagactggagaggaagcgactgcggggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttacaccttgtagagatgttctctaactcaggcaactgcaagtagctctagccttttcttttctttttttttttttgagacggagtctcactctgtcacacaggctggagtgcagtggcacgatcttggctcactgcaacctcagcctcccaggttcaagagattctcctgcctcagcctccccagtagctgtgattaaagggcgcctgccaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaattttttttttgagacggagtctcgctctgtcgcccaggctggagtgcagtggcacgatctcggctcactgcaaactccgccttccaggttcacgccattctcctgcctcagcctcccaagtagctgggactataggcacctactaccacgcctggctaattttttgtatttttagtagagacggggtttcaccatgttagccaggatggtctccatctcctgaccttgtgatccacccacctcggcttcccccagctaattttttatattttagtagagacaaggtttcgccatgttggccaggctggtcttgaactcctgacctcaggtgatccgtctgctttggcctcccaaagtgctgggattagaagcgtgagccaccacgcccagcctttttttgtatttttagtagagatggggtttcgccatgttggccaggctggtctcaaactcctgacctcaggtgatctgcccacctcagcctcccaaagtgctaggattacaggataagccactgcacctggccagctctagtcttattttgtggcctgggacactggagacgtgggtttaccacacagccttgggaaatttatctaactctctgggcccctttgtacttttcagcttagagatttgggggttaaagtagatcagtaatttccaaactcttcacagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgcttaaaaaaaaaaagtcgacgcggccgcgaatttagtagtagta

SEQ ID NO: 286929 - DNA, 2600 bp, Homo sapiens
ctcggttatggaggaggccttccgctcgcagcggcctctccagcaccccttttaggcctgagcacccgcaggggtgcccaggccgcacgccaaacgcgggcccgcgccggttacctggctgcgcgctcccgctctgcctcgcgattctccggaatcgtacctcttcgtgggctcgcgccagcgctgtgagcgcacaattagtttaaactatggccccgccccctcgcgctgccctctgattggcctctgtcggcggggcccgcttaaggacccgggaaaaggaagtttgagggccactgggaaagagaaggggtatcaccgcttccggaccccggcctgtacttgaaggcaaagagaactacaaatcccagcgtcacccgcggccttgaagccccgcccctgacaaactgaaggtcccggtaagcatcgcgtcagtacttatggcgcctgccgggttgtggtgacgaaagcagttgccatggagttgctctgagtaaccctgaggcagtgggacgccaagactggagaggaagcgactgcggggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttacaccttgtagagatgttctctaactcaggcaactgcaagtagctctagccttttcttttctttttttttttttgagacggagtctcactctgtcacacaggctggagtgcagtggcacgatcttggctcactgcaacctcagcctcccaggttcaagagattctcctgcctcagcctccccagtagctgtgattaaagggcgcctgccaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaattttttttttgagacggagtctcgctctgtcgcccaggctggagtgcagtggcacgatctcggctcactgcaaactccgccttccaggttcacgccattctcctgcctcagcctcccaagtagctgggactataggcacctactaccacgcctggctaattttttgtatttttagtagagacggggtttcaccatgttagccaggatggtctccatctcctgaccttgtgatccacccacctcggcttcccccagctaattttttatattttagtagagacaaggtttcgccatgttggccaggctggtcttgaactcctgacctcaggtgatccgtctgctttggcctcccaaagtgctgggattagaagcgtgagccaccacgcccagcctttttttgtatttttagtagagatggggtttcgccatgttggccaggctggtctcaaactcctgacctcaggtgatctgcccacctcagcctcccaaagtgctaggattacaggataagccactgcacctggccagctctagtcttattttgtggcctgggacactggagacgtgggtttaccacacagccttgggaaatttatctaactctctgggcccctttgtacttttcagcttagagatttgggggttaaagtagatcagtaatttccaaactcttcacagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgcttaaaaa

SEQ ID NO: 286930 - DNA, 2511 bp, Homo sapiens
ctcggttatggaggaggccttccgctcgcagcggcctctccagcaccccttttaggcctgagcacccgcaggggtgcccaggccgcacgccaaacgcgggcccgcgccggttacctggctgcgcgctcccgctctgcctcgcgattctccggaatcgtacctcttcgtgggctcgcgccagcgctgtgagcgcacaattagtttaaactatggccccgccccctcgcgctgccctctgattggcctctgtcggcggggcccgcttaaggacccgggaaaaggaagtttgagggccactgggaaagagaaggggtatcaccgcttccggaccccggcctgtacttgaaggcaaagagaactacaaatcccagcgtcacccgcggccttgaagccccgcccctgacaaactgaaggtcccgggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttacaccttgtagagatgttctctaactcaggcaactgcaagtagctctagccttttcttttctttttttttttttgagacggagtctcactctgtcacacaggctggagtgcagtggcacgatcttggctcactgcaacctcagcctcccaggttcaagagattctcctgcctcagcctccccagtagctgtgattaaagggcgcctgccaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaattttttttttgagacggagtctcgctctgtcgcccaggctggagtgcagtggcacgatctcggctcactgcaaactccgccttccaggttcacgccattctcctgcctcagcctcccaagtagctgggactataggcacctactaccacgcctggctaattttttgtatttttagtagagacggggtttcaccatgttagccaggatggtctccatctcctgaccttgtgatccacccacctcggcttcccccagctaattttttatattttagtagagacaaggtttcgccatgttggccaggctggtcttgaactcctgacctcaggtgatccgtctgctttggcctcccaaagtgctgggattagaagcgtgagccaccacgcccagcctttttttgtatttttagtagagatggggtttcgccatgttggccaggctggtctcaaactcctgacctcaggtgatctgcccacctcagcctcccaaagtgctaggattacaggataagccactgcacctggccagctctagtcttattttgctgaaaaagggaggcaattgagggaaaggcctgctggcctgggacactggagacgtgggtttaccacacagccttgggaaatttatctaactctctgggcccctttgtacttttcagcttagagatttgggggttaaagtagatcagtaatttccaaactcttcacagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgcttaaaaa

SEQ ID NO: 286931 - DNA, 2497 bp, Homo sapiens
ctcggttatggaggaggccttccgctcgcagcggcctctccagcaccccttttaggcctgagcacccgcaggggtgcccaggccgcacgccaaacgcgggcccgcgccggttacctggctgcgcgctcccgctctgcctcgcgattctccggaatcgtacctcttcgtgggctcgcgccagcgctgtgagcgcacaattagtttaaactatggccccgccccctcgcgctgccctctgattggcctctgtcggcggggcccgcttaaggacccgggaaaaggaagtttgagggccactgggaaagagaaggggtatcaccgcttccggaccccggcctgtacttgaaggcaaagagaactacaaatcccagcgtcacccgcggccttgaagccccgcccctgacaaactgaaggtcccggtaagcatcgcgtcagtacttatggcgcctgccgggttgtggtgacgaaagcagttgccatggagttgctctgagtaaccctgaggcagtgggacgccaagactggagaggaagcgactgcggggagtatttccattttaaccggaaacaatccctgaacccacaggaatgaatgcctaatggtggagtttcagccatcagtgacagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttacaccttgtagagatgttctctaactcaggcaactgcaagtagctctagccttttcttttctttttttttttttgagacggagtctcactctgtcacacaggctggagtgcagtggcacgatcttggctcactgcaacctcagcctcccaggttcaagagattctcctgcctcagcctccccagtagctgtgattaaagggcgcctgccaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaattttttttttgagacggagtctcgctctgtcgcccaggctggagtgcagtggcacgatctcggctcactgcaaactccgccttccaggttcacgccattctcctgcctcagcctcccaagtagctgggactataggcacctactaccacgcctggctaattttttgtatttttagtagagacggggtttcaccatgttagccaggatggtctccatctcctgaccttgtgatccacccacctcggcttcccccagctaattttttatattttagtagagacaaggtttcgccatgttggccaggctggtcttgaactcctgacctcaggtgatccgtctgctttggcctcccaaagtgctgggattagaagcgtgagccaccacgcccagcctttttttgtatttttagtagagatggggtttcgccatgttggccaggctggtctcaaactcctgacctcaggtgatctgcccacctcagcctcccaaagtgctaggattacaggataagccactgcacctggccagctctagtcttattttgctgaaaaagggaggcaattgagggaaaggcctgctggcctgggacactggagacgtgggtttaccacacagccttgggaaatttatctaactctctgggcccctttgtacttttcagcttagagatttgggggttaaagtagatcagtaatttccaaactcttcacagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgcttaaaaa

SEQ ID NO: 286932 - DNA, 2290 bp, Homo sapiens
ctcggttatggaggaggccttccgctcgcagcggcctctccagcaccccttttaggcctgagcacccgcaggggtgcccaggccgcacgccaaacgcgggcccgcgccggttacctggctgcgcgctcccgctctgcctcgcgattctccggaatcgtacctcttcgtgggctcgcgccagcgctgtgagcgcacaattagtttaaactatggccccgccccctcgcgctgccctctgattggcctctgtcggcggggcccgcttaaggacccgggaaaaggaagtttgagggccactgggaaagagaaggggtatcaccgcttccggaccccggcctgtacttgaaggcaaagagaactacaaatcccagcgtcacccgcggccttgaagccccgcccctgacaaactgaaggtcccgatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttacaccttgtagagatgttctctaactcaggcaactgcaagtagctctagccttttcttttctttttttttttttgagacggagtctcactctgtcacacaggctggagtgcagtggcacgatcttggctcactgcaacctcagcctcccaggttcaagagattctcctgcctcagcctccccagtagctgtgattaaagggcgcctgccaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaattttttttttgagacggagtctcgctctgtcgcccaggctggagtgcagtggcacgatctcggctcactgcaaactccgccttccaggttcacgccattctcctgcctcagcctcccaagtagctgggactataggcacctactaccacgcctggctaattttttgtatttttagtagagacggggtttcaccatgttagccaggatggtctccatctcctgaccttgtgatccacccacctcggcttcccccagctaattttttatattttagtagagacaaggtttcgccatgttggccaggctggtcttgaactcctgacctcaggtgatccgtctgctttggcctcccaaagtgctgggattagaagcgtgagccaccacgcccagcctttttttgtatttttagtagagatggggtttcgccatgttggccaggctggtctcaaactcctgacctcaggtgatctgcccacctcagcctcccaaagtgctaggattacaggataagccactgcacctggccagctctagtcttattttgctgaaaaagggaggcaattgagggaaaggcctgctggcctgggacactggagacgtgggtttaccacacagccttgggaaatttatctaactctctgggcccctttgtacttttcagcttagagatttgggggttaaagtagatcagtaatttccaaactcttcacagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgcttaaaaa

SEQ ID NO: 286933 - DNA, 3495 bp, Homo sapiens
aataagatgcgatactagctcacagcctgggctacagcttaaatgcagaaggctaaaaatttaaccagcttcttggggctccatttttaatactaattcattcagaaaatgcaacaggagctggtgctacacaaaatcagaagtctttaggaactgcactgggttgctctgttagtcaagaaaactaacagtaaaaatctgcccttaagtattttaagttaaaatccatgttcagtggtgcataactctggggtaccaacccagtatttactttgagaaaagtatccaatcttgctcaaaggtatcaaatctgttgtaggtgctgaagtgggatgagcttctgtctaagctaggttcctctagttctgtagtagacagccaggttcctctatttttacaaaagaataatgtgttctttgttgtctgcctgtagatttaatatctaaaagattcaagtctccctaattgacaatccatgcccatgggaccagttcataacagaattaagctgtgaagtgactcaatctgtcacctccccaaagctcagctggtactgctattttttcagaacaagacattcattttcctctaaacctactaaacttgatccatgtatatgttaaattgccaaaaaaggaatttacatgaactgtattaggcttaaactgaattataagatatcaggtccttggtttttaacagaaattcttttttttttttttttttttttttttttcctgagacagggtctacagggtcttgctctgtcgcccaggctggagtgcagtggcacaattatagctcactgcaacctccaacttctaggctcaagcaatccaactgcctcagcctcccgagtaataaattccattttaaagttgtttgccaatttcattgtctctgcaaactaatttatcctttgaatccaatgatgagaactgcaatcccaaggtttctctttttgctttggctgccaggaatttcagagctaaatgtaggcttagattcttaaagtgcctggcacatctctctcttcctgtaatctagtttctgatctttctcttccatttttaactttctaatctgcactgtccagtatggtagccactagtcacgtacatttgacaggtaggctagtccaaattgggatgtgctgtaagtgtaaaatatctcagtaagttttaatattgattacatattgaatgattttttgatatattgggtaaaattaagttattaaaattaatttcaccacttcattttacttattttggctactagaaaattttaaattatatatatggcttgcatttgtgacattatatttctagtggatggcactattctgcaaatcatctgttttatgactgtgttattattgtaaacctgaaatccttttggaaagcaggtgaagtaatacaaataataatacaaaggtggcagcagtggatggaatgagaaaggggaggtcgactgggacaagttcttgtccttatccttgtcaatttgtcttttgcttgtgtgattcacatacaaaccccttggtaaagtgtgttgtcagctctcttcatcccaggtgagtagtattctcatggctctcccttgtctccagaaaaacctcagctttactttagctaacaaattggaaacgatctgataagacaattcacaccacattgcaagtgactgataacaacattgtgttcatccctgtcagggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtatagacggagtctcactctgtcacacaggctggagtgcagtggcacgatcttggctcactgcaacctcagcctcccaggttcaagagattctcctgcctcagcctccccagtagctgtgattaaagggcgcctgccaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaattttttttttgagacggagtctcgctctgtcgcccaggctggagtgcagtggcacgatctcggctcactgcaaactccgccttccaggttcacgccattctcctgcctcagcctcccaagtagctgggactataggcacctactaccacgcctggctaattttttgtatttttagtagagacggggtttcaccatgttagccaggatggtctccatctcctgaccttgtgatccacccacctcggcttcccccagctaattttttatattttagtagagacaaggtttcgccatgttggccaggctggtcttgaactcctgacctcaggtgatccgtctgctttggcctcccaaagtgctgggattagaagcgtgagccaccacgcccagcctttttttgtatttttagtagagatggggtttcgccatgttggccaggctggtctcaaactcctgacctcaggtgatctgcccacctcagcctcccaaagtgctaggattacaggataagccactgcacctggccagctctagtcttattttgctgaaaaagggaggcaattgagggaaaggcctgctggcctgggacactggagacgtgggtttaccacacagccttgggaaatttatctaactctctgggcccctttgtacttttcagcttagagatttgggggttaaagtagatcagtaatttccaaactcttcacagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgcttaaaaa

SEQ ID NO: 286934 - DNA, 2466 bp, Homo sapiens
aataagatgcgatactagctcacagcctgggctacagcttaaatgcagaaggctaaaaatttaaccagcttcttggggctccatttttaatactaattcattcagaaaatgcaacaggagctggtgctacacaaaatcagaagtctttaggaactgcactgggttgctctgttagtcaagaaaactaacagtaaaaatctgcccttaagtattttaagttaaaatccatgttcagtggtgcataactctggggtaccaacccagtatttactttgagaaaagtatccaatcttgctcaaaggtatcaaatctgttgtaggtgctgaagtgggatgagcttctgtctaagctaggttcctctagttctgtagtagacagccaggttcctctatttttacaaaagaataatgtgttctttgttgtctgcctgtagatttaatatctaaaagattcaagtctccctaattgacaatccatgcccatgggaccagttcataacagaattaagctgtgaagtgactcaatctgtcacctccccaaagctcagctggtactgctattttttcagaacaagacattcattttcctctaaacctactaaacttgatccatgtatatgttaaattgccaaaaaaggaatttacatgaactgtattaggcttaaactgaattataagatatcaggtccttggtttttaacagaaattcttttttttttttttttttttttttttttcctgagacagggtctacagggtcttgctctgtcgcccaggctggagtgcagtggcacaattatagctcactgcaacctccaacttctaggctcaagcaatccaactgcctcagcctcccgagtaataaattccattttaaagttgtttgccaatttcattgtctctgcaaactaatttatcctttgaatccaatgatgagaactgcaatcccaaggtttctctttttgctttggctgccaggaatttcagagctaaatgtaggcttagattcttaaagtgcctggcacatctctctcttcctgtaatctagtttctgatctttctcttccatttttaactttctaatctgcactgtccagtatggtagccactagtcacgtacatttgacaggtaggctagtccaaattgggatgtgctgtaagtgtaaaatatctcagtaagttttaatattgattacatattgaatgattttttgatatattgggtaaaattaagttattaaaattaatttcaccacttcattttacttattttggctactagaaaattttaaattatatatatggcttgcatttgtgacattatatttctagtggatggcactattctgcaaatcatctgttttatgactgtgttattattgtaaacctgaaatccttttggaaagcaggtgaagtaatacaaataataatacaaaggtggcagcagtggatggaatgagaaaggggaggtcgactgggacaagttcttgtccttatccttgtcaatttgtcttttgcttgtgtgattcacatacaaaccccttggtaaagtgtgttgtcagctctcttcatcccaggtgagtagtattctcatggctctcccttgtctccagaaaaacctcagctttactttagctaacaaattggaaacgatctgataagacaattcacaccacattgcaagtgactgataacaacattgtgttcatccctgtcagggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtatagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgcttaaaaa

SEQ ID NO: 286935 - DNA, 2113 bp, Homo sapiens
aataagatgcgatactagctcacagcctgggctacagcttaaatgcagaaggctaaaaatttaaccagcttcttggggctccatttttaatactaattcattcagaaaatgcaacaggagctggtgctacacaaaatcagaagtctttaggaactgcactgggttgctctgttagtcaagaaaactaacagtaaaaatctgcccttaagtattttaagttaaaatccatgttcagtggtgcataactctggggtaccaacccagtatttactttgagaaaagtatccaatcttgctcaaaggtatcaaatctgttgtaggtgctgaagtgggatgagcttctgtctaagctaggttcctctagttctgtagtagacagccaggttcctctatttttacaaaagaataatgtgttctttgttgtctgcctgtagatttaatatctaaaagattcaagtctccctaattgacaatccatgcccatgggaccagttcataacagaattaagctgtgaagtgactcaatctgtcacctccccaaagctcagctggtactgctattttttcagaacaagacattcattttcctctaaacctactaaacttgatccatgtatatgttaaattgccaaaaaaggaatttacatgaactgtattaggcttaaactgaattataagatatcaggtccttggtttttaacagaaattcttttttttttttttttttttttttttttcctgagacagggtctacagggtcttgctctgtcgcccaggctggagtgcagtggcacaattatagctcactgcaacctccaacttctaggctcaagcaatccaactgcctcagcctcccgagtaataaattccattttaaagttgtttgccaatttcattgtctctgcaaactaatttatcctttgaatccaatgatgagaactgcaatcccaaggtttctctttttgctttggctgccaggaatttcagagctaaatgtaggcttagattcttaaagtgcctggcacatctctctcttcctgtaatctagtttctgatctttctcttccatttttaactttctaatctgcactgtccagtatggtagccactagtcacgtacatttgacaggtaggctagtccaaattgggatgtgctgtaagtgtaaaatatctcagtaagttttaatattgattacatattgaatgattttttgatatattgggtaaaattaagttattaaaattaatttcaccacttcattttacttattttggctactagaaaattttaaattatatatatggcttgcatttgtgacattatatttctagtggatggcactattctgcaaatcatctgttttatgactgtgttattattgtaaacctgaaatccttttggaaagcaggtgaagtaatacaaataataatacaaaggtggcagcagtggatggaatgagaaaggggaggtcgactgggacaagttcttgtccttatccttgtcaatttgtcttttgcttgtgtgattcacatacaaaccccttggtaaagtgtgttgtcagctctcttcatcccaggtgagtagtattctcatggctctcccttgtctccagaaaaacctcagctttactttagctaacaaattggaaacgatctgataagacaattcacaccacattgcaagtgactgataacaacattgtgttcatccctgtcagggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaaggtcagcccccagagcacagtactccactcactaaggcagcaggcccagtgtggtccctaggaagaaaccataatctacttaaaagcctaaagagattcttcccatatgcttgcagatgtgttgttactgtcttttggagggtaggggagagtgagaggtttttttctgtcttttt

SEQ ID NO: 286936 - DNA, 2670 bp, Homo sapiens
ctcggttatggaggaggccttccgctcgcagcggcctctccagcaccccttttaggcctgagcacccgcaggggtgcccaggccgcacgccaaacgcgggcccgcgccggttacctggctgcgcgctcccgctctgcctcgcgattctccggaatcgtacctcttcgtgggctcgcgccagcgctgtgagcgcacaattagtttaaactatggccccgccccctcgcgctgccctctgattggcctctgtcggcggggcccgcttaaggacccgggaaaaggaagtttgagggccactgggaaagagaaggggtatcaccgcttccggaccccggcctgtacttgaaggcaaagagaactacaaatcccagcgtcacccgcggccttgaagccccgcccctgacaaactgaaggtcccggtaagcatcgcgtcagtacttatggcgcctgccgggttgtggtgacgaaagcagttgccatggagttgctctgagtaaccctgaggcagtgggacgccaagactggagaggaagcgactgcggggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttacaccttgtagagatgttctctaactcaggcaactgcaagtagctctagccttttcttttctttttttttttttgagacggagtctcactctgtcacacaggctggagtgcagtggcacgatcttggctcactgcaacctcagcctcccaggttcaagagattctcctgcctcagcctccccagtagctgtgattaaagggcgcctgccaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaattttttttttgagacggagtctcgctctgtcgcccaggctggagtgcagtggcacgatctcggctcactgcaaactccgccttccaggttcacgccattctcctgcctcagcctcccaagtagctgggactataggcacctactaccacgcctggctaattttttgtatttttagtagagacggggtttcaccatgttagccaggatggtctccatctcctgaccttgtgatccacccacctcggcttcccccagctaattttttatattttagtagagacaaggtttcgccatgttggccaggctggtcttgaactcctgacctcaggtgatccgtctgctttggcctcccaaagtgctgggattagaagcgtgagccaccacgcccagcctttttttgtatttttagtagagatggggtttcgccatgttggccaggctggtctcaaactcctgacctcaggtgatctgcccacctcagcctcccaaagtgctaggattacaggataagccactgcacctggccagctctagtcttattttgctgaaaaagggaggcaattgagggaaaggcctgctggcctgggacactggagacgtgggtttaccacacagccttgggaaatttatctaactctctgggcccctttgtacttttcagcttagagatttgggggttaaagtagatcagtaatttccaaactcttcacagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgcttaaaaaaaaaaagtcgacgcggccgcgaatttagtagtagta

SEQ ID NO: 286937 - DNA, 2591 bp, Homo sapiens
ctcggttatggaggaggccttccgctcgcagcggcctctccagcaccccttttaggcctgagcacccgcaggggtgcccaggccgcacgccaaacgcgggcccgcgccggttacctggctgcgcgctcccgctctgcctcgcgattctccggaatcgtacctcttcgtgggctcgcgccagcgctgtgagcgcacaattagtttaaactatggccccgccccctcgcgctgccctctgattggcctctgtcggcggggcccgcttaaggacccgggaaaaggaagtttgagggccactgggaaagagaaggggtatcaccgcttccggaccccggcctgtacttgaaggcaaagagaactacaaatcccagcgtcacccgcggccttgaagccccgcccctgacaaactgaaggtcccggtaagcatcgcgtcagtacttatggcgcctgccgggttgtggtgacgaaagcagttgccatggagttgctctgagtaaccctgaggcagtgggacgccaagactggagaggaagcgactgcgggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttacaccttgtagagatgttctctaactcaggcaactgcaagtagctctagccttttcttttctttttttttttttgagacggagtctcactctgtcacacaggctggagtgcagtggcacgatcttggctcactgcaacctcagcctcccaggttcaagagattctcctgcctcagcctccccagtagctgtgattaaagggcgcctgccaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaattttttttttgagacggagtctcgctctgtcgcccaggctggagtgcagtggcacgatctcggctcactgcaaactccgccttccaggttcacgccattctcctgcctcagcctcccaagtagctgggactataggcacctactaccacgcctggctaattttttgtatttttagtagagacggggtttcaccatgttagccaggatggtctccatctcctgaccttgtgatccacccacctcggcttcccccagctaattttttatattttagtagagacaaggtttcgccatgttggccaggctggtcttgaactcctgacctcaggtgatccgtctgctttggcctcccaaagtgctgggattagaagcgtgagccaccacgcccagcctttttttgtatttttagtagagatggggtttcgccatgttggccaggctggtctcaaactcctgacctcaggtgatctgcccacctcagcctcccaaagtgctaggattacaggataagccactgcacctggccagctctagtcttattttgctgaaaaagggaggcaattgagggaaaggcctgctggcctgggacactggagacgtgggtttaccacacagccttgggaaatttatctaactctctgggcccctttgtacttttcagcttagagatttgggggttaaagtagatcagtaatttccaaactcttcacagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgcttaaaaa

SEQ ID NO: 286938 - DNA, 1906 bp, Homo sapiens
gcctcgtgccgaattcggcacgaggacgtcattcaatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttacaccttgtagagatgttctctaactcaggcaactgcaagtagctctagccttttcttttctttttttttttttgagacggagtctcactctgtcacacaggctggagtgcagtggcacgatcttggctcactgcaacctcagcctcccaggttcaagagattctcctgcctcagcctccccagtagctgtgattaaagggcgcctgccaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaattttttttttgagacggagtctcgctctgtcgcccaggctggagtgcagtggcacgatctcggctcactgcaaactccgccttccaggttcacgccattctcctgcctcagcctcccaagtagctgggactataggcacctactaccacgcctggctaattttttgtatttttagtagagacggggtttcaccatgttagccaggatggtctccatctcctgaccttgtgatccacccacctcggcttcccccagctaattttttatattttagtagagacaaggtttcgccatgttggccaggctggtcttgaactcctgacctcaggtgatccgtctgctttggcctcccaaagtgctgggattagaagcgtgagccaccacgcccagcctttttttgtatttttagtagagatggggtttcgccatgttggccaggctggtctcaaactcctgacctcaggtgatctgcccacctcagcctcccaaagtgctaggattacaggataagccactgcacctggccagctctagtcttattttgctgaaaaagggaggcaattgagggaaaggcctgctggcctgggacactggagacgtgggtttaccacacagccttgggaaatttatctaactctctgggcccctttgtacttttcagcttagagatttgggggttaaagtagatcagtaatttccaaactcttcacagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgcttaaaaa

SEQ ID NO: 286939 - DNA, 1148 bp, Homo sapiens
tgtttgtttgttttgtttttggtcgatttatttaactgctagtaaaaggagctttctgcagtgtcggctgggatcccacacagctgtggcagccagggctgcggcggcggctcggtcgcggcttgtgtccccgctgcccctgctgctgctggtctctgctccggacgcgctcagaaggtgccaccgccgccttctctggccggctggccgccgggagtgaacgcgcccccgcctcctgtctgctcttctgtccgtctgcacgtctgtcagtccgaccgtctgtgggtccgactagcagctcggcgcgggattctcgctttgctgcgctctgctctcaaagctgccactctcgcaggctgccagtctgtgcgctggtctgtccgtccgtccgaatccctccgtcccaccagcaatgcagcgtccctcttccggtcttctgtgcccacagtcctctcccactctgtgcccctggccgcttcgctcggctgtctgactgctcccacctgtccgtagctctgccagtcccacccctagccagccagcctcggtcgatccctcggtcccgttcctccagcttggccgcctccgtcgtctgcccctccgccggtccgtgccctcccacgcggctggcactgccgccgggggcggcgcccggctcctccccgcagctccggatgcgtccggtccccgcccgggctgagggcaacgcgcgtgttgcacgtggctccacagctgctctggccggagaccccgggccccagacccgccacacccgggaggtggcggcagccggacgcctgccagtgtcgccgcctctgcgccactgggagcatccagaactggcccatccagagtgatggcacctgctgggtgcgccgggcgcccgcggtaccactcattccctgggccgttctccgccagccctaaggctggagacaaagcgcatgagccacgcgcagcagcgtgagcatcattaatcagaaagaaaactggcacgttgccccctgccccgccacaccgcctccctgctcccagcgagcaggcatgtattctctcttgtcccccgtgcccaggccctccagcgtacccgtctcgggggcgcccctggactcctggggactcttgacgaagccttgttccactccctc

SEQ ID NO: 286940 - DNA, 1267 bp, Homo sapiens
tgtttgtttgttttgtttttggtcgatttatttaactgctagtaaaaggagctttctgcagtgtcggctgggatcccacacagctgtggcagccagggctgcggcggcggctcggtcgcggcttgtgtccccgctgcccctgctgctgctggtctctgctccggacgcgctcagaaggtgccaccgccgccttctctggccggctggccgccgggagtgaacgcgcccccgcctcctgtctgctcttctgtccgtctgcacgtctgtcagtccgaccgtctgtgggtccgactagcagctcggcgcgggattctcgctttgctgcgctctgctctcaaagctgccactctcgcaggctgccagtctgtgcgctggtctgtccgtccgtccgaatccctccgtcccaccagcaatgcagcgtccctcttccggtcttctgtgcccacagtcctctcccactctgtgcccctggccgcttcgctcggtaagaggagggcgtgtggagggagggagcacgcgagtgttgctgtctatctttctgtgtgcctctccctgcctacttaatgctctcgctctctttgcgttctggtctccctctctcaggctgtctgactgctcccacctgtccgtagctctgccagtcccacccctagccagccagcctcggtcgatccctcggtcccgttcctccagcttggccgcctccgtcgtctgcccctccgccggtccgtgccctcccacgcggctggcactgccgccgggggcggcgcccggctcctccccgcagctccggatgcgtccggtccccgcccgggctgagggcaacgcgcgtgttgcacgtggctccacagctgctctggccggagaccccgggccccagacccgccacacccgggaggtggcggcagccggacgcctgccagtgtcgccgcctctgcgccactgggagcatccagaactggcccatccagagtgatggcacctgctgggtgcgccgggcgcccgcggtaccactcattccctgggccgttctccgccagccctaaggctggagacaaagcgcatgagccacgcgcagcagcgtgagcatcattaatcagaaagaaaactggcacgttgccccctgccccgccacaccgcctccctgctcccagcgagcaggcatgtattctctcttgtcccccgtgcccaggccctccagcgtacccgtctcgggggcgcccctggactcctggggactcttgacgaagccttgttccactccctc

SEQ ID NO: 286941 - DNA, 496 bp, Homo sapiens
gaggaaggaaacatgcaatcacaaacaatgaacaactctaaagacaaaaaggttggtccaaaagaactcaacataattaatccaatgactgtgaagagcttcactgagtaggattaagatattgcagatgtagtgtttccacagggtggctcttcagtgcaccagcggggcctgcttgagggagatgaggactgagcgcatgcgggagacatctttggcctgcttgctagacttggggttaaagtcacacagccgggccacccgttcccactcagtgcctggggacgactcgtcaatgtcatttacaaaggcttcttctgctgccctgttgtttgctttgggtgtctacaaatgaaagcaaaagcaatgcaagtactggtttcagatttacaaataaattttagtgagtaggcatgaaataatgagcatcagctgtacaaaggaaataatgagcatcaactgtacaaagaaaaggtaagaaaataaagagtccagc

SEQ ID NO: 286942 - DNA, 766 bp, Homo sapiens
  misc_feature (750)..(750): n is a, c, g, or t
gccaaactgctggaattgcaggtgtgagccactcactgtgtccggcataaagtagaacattcttacaagaaataaatatttcgtagtcatggagaagaacgctcctaaaatgatgaacgcacgacggaaaagagtagggaacattttgcttgatgagaaaatccgccagcaaggatgttgggctctaagcagaactgaagctctggaattaagaacacagccaaggaagagctctggactctgagtttaaagaagctgactgacttgtaaggcaattccaggtaagattggtgaatcaagttaagaatcaaaagcaactgagatcaacgtggaggcctggaaggtaagggcccatattttacctagatactagcttagagacttgctacattggcactgtattttaagtatgttatttagtagtattgtgaaatcaactggtttcaacattgaaaaggataaaaatagcttatgaaaaccaaacggtttttttttttttaaaggataaggtgcatgtttaatttcaattgcagaaatgaagggaagaggcactcctgccacctggtgggcatttatccaaattgtttgttcaggtcttttaggggtgaaattcgggttgttgaatctaggttgaacacacaaacattccagccccagcagcagttgggtcttatttccttccccttgacctgggatctgtacctttctgtttccaattaaggcctctctcgtgaggactcagtcagtccngtgggggatcctctag

SEQ ID NO: 286943 - DNA, 725 bp, Homo sapiens
  misc_feature (709)..(709): n is a, c, g, or t
cctgccaaatgctggatgaggatcgagtagaacattcttacaagaaatatactagtcatgacgcctaaatgatgaacgcacgacggaaaagagtagggaacattttgcttgatgagaaaatccgccagcaaggatgttgggctctaagcagaactgaagctctggaattaagaacacagccaaggaagagctctggactctgagtttaaagaagctgactgacttgtaaggcaattccaggtaagattggtgaatcaagttaagaatcaaaagcaactgagatcaacgtggaggcctggaaggtaagggcccatattttacctagatactagcttagagacttgctacattggcactgtattttaagtatgttatttagtagtattgtgaaatcaactggtttcaacattgaaaaggataaaaatagcttatgaaaaccaaacggtttttttttttttaaaggataaggtgcatgtttaatttcaattgcagaaatgaagggaagaggcactcctgccacctggtgggcatttatccaaattgtttgttcaggtcttttaggggtgaaattcgggttgttgaatctaggttgaacacacaaacattccagccccagcagcagttgggtcttatttccttccccttgacctgggatctgtacctttctgtttccaattaaggcctctctcgtgaggactcagtcagtccngtgggggatcctctag

SEQ ID NO: 286944 - DNA, 270 bp, Homo sapiens
tatgtatttcttgtagagacagagtctcgctgtgttgcctacactggtctagaactcctggcctcaagcgatcctcctgcctcggcctgccaaactgctggaattgcaggtgtgagccactcactgtgtccggcataaagtagaacattcttacaagaaataaatatttcgtagtcatggagaagaacgctcctaaaatgtatgtatccgttcattcatccatccattcattcattcttttatggggcggggggtctgttgcttatgctg

SEQ ID NO: 286945 - DNA, 463 bp, Homo sapiens
atctcaggccacacaggattccattcatcgaacattcctgagacaacggaattctggcgatggagcacaggatgcttcacagtctacggcaaaggacagaacgttggttgctcgagagcccgtcttaagtctcctatgagcttcaagccaacacaacagagggcaaactccaggctacccgatccctcagcaaagatgcagatggacacagcgttctggccccacgcatctgaagttcgtcttaagatgtgtgaaagcctcagcgcatgagccaattctgtgcagtgctcgacatacagatgagaacactgaggcacgaggcacagcctgtgatctggccaccgcgctcaggaggaggtggttacccgcgggcctgagggcgctgactttttagaatgggcgagtgcagctgtgtcccagtgtcccagtgaccagaacgattactgcctttaaaaaaaaaaaa

SEQ ID NO: 286946 - DNA, 689 bp, Homo sapiens
tctcacaggatacatggctatgaaagacattcatcatactgtgggctagcctgaaccagccactctggagagaccacttgtcaaggcacaatggatacgaactgaatctcaacaaccagcatcaaccatcaaaagatatgcaaagaagcctcagctgtttagcctcatctctgctccgtgatgattctcatctgccagaaggaatggaaggacatcatatcatcataatgcagctataaatttatggcgcttttttctctcacaggatatatacccagtaatgactgatcgacttacaacagtgatataattctggaattttcttctgttttgcaattttgacttggagtgctgatctcccacatgtcattatttcaactagccctaaatgaaagaaacaacataattaataaagtcattctcaaatatgggcaattatgtattatcaaacacctaaacatctagattcaacttggcaaaagaaaagcaaattttcttcccctttcacatcgtttatttagattttgacggattatttttaaagaaggtaatttaactgtgttaatatatactctaaatgtcaatctaaacgtatttttcctctgtatgtaatacagtgtattgattatgaattcatatcgtatttctgattcatttgtcatcattaaaataaagccagattattccag

SEQ ID NO: 286947 - DNA, 631 bp, Homo sapiens
tctcacaggatacatggctatgaaagacattcatcatactgtgggctagcctgaaccagccactctggagagaccacttgtcaaggcacaatggatacgaactgaatctcaacaaccagcatcaaccatcaaaagatatgcaagaatggaaggacatcatatcatcataatgcagctataaatttatggcgcttttttctctcacaggatatatacccagtaatgactgatcgacttacaacagtgatataattctggaattttcttctgttttgcaattttgacttggagtgctgatctcccacatgtcattatttcaactagccctaaatgaaagaaacaacataattaataaagtcattctcaaatatgggcaattatgtattatcaaacacctaaacatctagattcaacttggcaaaagaaaagcaaattttcttcccctttcacatcgtttatttagattttgacggattatttttaaagaaggtaatttaactgtgttaatatatactctaaatgtcaatctaaacgtatttttcctctgtatgtaatacagtgtattgattatgaattcatatcgtatttctgattcatttgtcatcattaaaataaagccagattattccag

SEQ ID NO: 286948 - DNA, 1951 bp, Homo sapiens
  misc_feature (1942)..(1951): n is a, c, g, or t
ccctgcggcggccccgaggacgtggccctggcgccctgcaccgccgccgccgcctgcgaagcgggcccctccccggtctacgtcaaggtcaagagcgcggagccggctgactgcgccgaggggccggtgcagtgcaagaacggcctcttggtgagaacagatgcaaaaactattgctcaaggaaaataaagtgaaaacgaggaaaagcaaaagaagatctggagagggctctcacctgaccacaagcatcctggagcaatgagtttcaggcaggaagactcatcctgagctgagctgcttttcttgaagttgtgcaagaacgtcctgttggctggggcaaattcagtatttcttttcctggccactgtgctggagcgtgaggaaagactctccaccctcactcccagatcctgcaggaggcgtgagagcggatggagatggtgaggatgtctattaatatggtgtttcctgcaaaacggtgcccatctcaaccatgggttgtcaaccatcctcggtgtctacaactgcaatttacctttgagggcccatgaactctgattacctgaaagtccttaggccagaaagagaaacccctgtcccccacctctcactttcacctatttctagaccttttcttacagcaatgccttggccctcaggaagcatcagatctcaaactgcagggtctggggctgaagctgatgctggcatgggtgactcagagttcctctattagttcaaatatgtaatatcttttagagcctaggactcaggctggaggcaattccttggtgccagttggttaatactttatgaatagtggtgggggagggaatgccttggactattaatgtccccatggatctggatcctggagaacttccagtgtcctggatggaatgttctgcttggctcatcttgcccagagaagagccaggatatgagaagatgggagagggaagggggaggtgtgaaacgtgctggtgcttcctgtcctcgtggtgtgatggctgcccaggctgctccttcgaggcaggacaggattcccatgggagatatgaggaccatggtgatttccaggcaccagttatgtcccagagcatcgtgtgcctgtgcagtggggttactgatagtccaggcatcagttcatattgtcctttatggcagatcctgcacaagggggttctctgtctctggacccactctgtcagcatggacatcctttttctttttccctggtaaggacatcagaaagaaagttacccctccagtgtttggagtcttggaatccttggcctgcctgcaggcctctgaatcctcagtgtgttagcccaaggtcaccttaggtaaaggaacatttctcctggtcttccaacaccctggaaagggaggctcttcaagaataggaaattcttcctagtatctaaccttggcctgcaactatgccatacatttaattgtagaaggtatggaaagttaggactgtggtggacccagttaaatcactggacagaagccatgaggcagagccagaaccagcttctggactccctgcatggagctttctactatcccaggttgttgggtcccttctcagtggccaaagatgctattttatgagccttgaggacatgacactaagtgaaaaaagcctggccaaagggccacatagtgtatagttctatttatatgaaatgtccaggaaagacaaaagcatagaggcagaaagcagactagtgctgtgggaggaatgggggatttgggaggtgatggctaaggggttatggggttttgggggaggtaatagaaatgttttaaaattggttgtgaaggtggatgcccaactctgcgaatacactaaaaggcatcgaattgtatactttaaataggtgaattgtatgctatgtgaattatatctcaataaaggtattttttccctgcnnnnnnnnnn

SEQ ID NO: 286949 - DNA, 2217 bp, Homo sapiens
  misc_feature (2208)..(2217): n is a, c, g, or t
ccctgcggcggccccgaggacgtggccctggcgccctgcaccgccgccgccgcctgcgaagcgggcccctccccggtctacgtcaaggtcaagagcgcggagccggctgactgcgccgaggggccggtgcagtgcaagaacggcctcttggtctccagcccacactgtgaagagccttgtgcccacagctgtgcacatcctgggcttcctccacaccttgtccataaactgcccctcagctaccttcagacccaggatacagacgcagcctccagaagaataaatgctccattagcagctggctggagctggctgaggctctggctggtgactctggcctctggtgtagacttccctcaggtgagtgcatggatgagagctctaccttctcctgactgcccaggcctcaggacaacaggagaacagatgcaaaaactattgctcaaggaaaataaagtgaaaacgaggaaaagcaaaagaagatctggagagggctctcacctgaccacaagcatcctggagcaatgagtttcaggcaggaagactcatcctgagctgagctgcttttcttgaagttgtgcaagaacgtcctgttggctggggcaaattcagtatttcttttcctggccactgtgctggagcgtgaggaaagactctccaccctcactcccagatcctgcaggaggcgtgagagcggatggagatggtgaggatgtctattaatatggtgtttcctgcaaaacggtgcccatctcaaccatgggttgtcaaccatcctcggtgtctacaactgcaatttacctttgagggcccatgaactctgattacctgaaagtccttaggccagaaagagaaacccctgtcccccacctctcactttcacctatttctagaccttttcttacagcaatgccttggccctcaggaagcatcagatctcaaactgcagggtctggggctgaagctgatgctggcatgggtgactcagagttcctctattagttcaaatatgtaatatcttttagagcctaggactcaggctggaggcaattccttggtgccagttggttaatactttatgaatagtggtgggggagggaatgccttggactattaatgtccccatggatctggatcctggagaacttccagtgtcctggatggaatgttctgcttggctcatcttgcccagagaagagccaggatatgagaagatgggagagggaagggggaggtgtgaaacgtgctggtgcttcctgtcctcgtggtgtgatggctgcccaggctgctccttcgaggcaggacaggattcccatgggagatatgaggaccatggtgatttccaggcaccagttatgtcccagagcatcgtgtgcctgtgcagtggggttactgatagtccaggcatcagttcatattgtcctttatggcagatcctgcacaagggggttctctgtctctggacccactctgtcagcatggacatcctttttctttttccctggtaaggacatcagaaagaaagttacccctccagtgtttggagtcttggaatccttggcctgcctgcaggcctctgaatcctcagtgtgttagcccaaggtcaccttaggtaaaggaacatttctcctggtcttccaacaccctggaaagggaggctcttcaagaataggaaattcttcctagtatctaaccttggcctgcaactatgccatacatttaattgtagaaggtatggaaagttaggactgtggtggacccagttaaatcactggacagaagccatgaggcagagccagaaccagcttctggactccctgcatggagctttctactatcccaggttgttgggtcccttctcagtggccaaagatgctattttatgagccttgaggacatgacactaagtgaaaaaagcctggccaaagggccacatagtgtatagttctatttatatgaaatgtccaggaaagacaaaagcatagaggcagaaagcagactagtgctgtgggaggaatgggggatttgggaggtgatggctaaggggttatggggttttgggggaggtaatagaaatgttttaaaattggttgtgaaggtggatgcccaactctgcgaatacactaaaaggcatcgaattgtatactttaaataggtgaattgtatgctatgtgaattatatctcaataaaggtattttttccctgcnnnnnnnnnn

SEQ ID NO: 286950 - DNA, 2061 bp, Homo sapiens
  misc_feature (2052)..(2061): n is a, c, g, or t
ccctgcggcggccccgaggacgtggccctggcgccctgcaccgccgccgccgcctgcgaagcgggcccctccccggtctacgtcaaggtcaagagcgcggagccggctgactgcgccgaggggccggtgcagtgcaagaacggcctcttggtctccagcccacactgtgaagagccttgtgcccacagctgtgcacatcctgggcttcctccacaccttgtccataaactgcccctcagctaccttcagacccaggatacaggagaacagatgcaaaaactattgctcaaggaaaataaagtgaaaacgaggaaaagcaaaagaagatctggagagggctctcacctgaccacaagcatcctggagcaatgagtttcaggcaggaagactcatcctgagctgagctgcttttcttgaagttgtgcaagaacgtcctgttggctggggcaaattcagtatttcttttcctggccactgtgctggagcgtgaggaaagactctccaccctcactcccagatcctgcaggaggcgtgagagcggatggagatggtgaggatgtctattaatatggtgtttcctgcaaaacggtgcccatctcaaccatgggttgtcaaccatcctcggtgtctacaactgcaatttacctttgagggcccatgaactctgattacctgaaagtccttaggccagaaagagaaacccctgtcccccacctctcactttcacctatttctagaccttttcttacagcaatgccttggccctcaggaagcatcagatctcaaactgcagggtctggggctgaagctgatgctggcatgggtgactcagagttcctctattagttcaaatatgtaatatcttttagagcctaggactcaggctggaggcaattccttggtgccagttggttaatactttatgaatagtggtgggggagggaatgccttggactattaatgtccccatggatctggatcctggagaacttccagtgtcctggatggaatgttctgcttggctcatcttgcccagagaagagccaggatatgagaagatgggagagggaagggggaggtgtgaaacgtgctggtgcttcctgtcctcgtggtgtgatggctgcccaggctgctccttcgaggcaggacaggattcccatgggagatatgaggaccatggtgatttccaggcaccagttatgtcccagagcatcgtgtgcctgtgcagtggggttactgatagtccaggcatcagttcatattgtcctttatggcagatcctgcacaagggggttctctgtctctggacccactctgtcagcatggacatcctttttctttttccctggtaaggacatcagaaagaaagttacccctccagtgtttggagtcttggaatccttggcctgcctgcaggcctctgaatcctcagtgtgttagcccaaggtcaccttaggtaaaggaacatttctcctggtcttccaacaccctggaaagggaggctcttcaagaataggaaattcttcctagtatctaaccttggcctgcaactatgccatacatttaattgtagaaggtatggaaagttaggactgtggtggacccagttaaatcactggacagaagccatgaggcagagccagaaccagcttctggactccctgcatggagctttctactatcccaggttgttgggtcccttctcagtggccaaagatgctattttatgagccttgaggacatgacactaagtgaaaaaagcctggccaaagggccacatagtgtatagttctatttatatgaaatgtccaggaaagacaaaagcatagaggcagaaagcagactagtgctgtgggaggaatgggggatttgggaggtgatggctaaggggttatggggttttgggggaggtaatagaaatgttttaaaattggttgtgaaggtggatgcccaactctgcgaatacactaaaaggcatcgaattgtatactttaaataggtgaattgtatgctatgtgaattatatctcaataaaggtattttttccctgcnnnnnnnnnn

SEQ ID NO: 286951 - DNA, 1563 bp, Homo sapiens
  misc_feature (1554)..(1563): n is a, c, g, or t
ccctgcggcggccccgaggacgtggccctggcgccctgcaccgccgccgccgcctgcgaagcgggcccctccccggtctacgtcaaggtcaagagcgcggagccggctgactgcgccgaggggccggtgcagtgcaagaacggcctcttggtctccagcccacactgtgaagagccttgtgcccacagctgtgcacatcctgggcttcctccacaccttgtccataaactgcccctcagctaccttcagacccaggatacagacgcagcctccagaagaataaatgctccattagcagctggctggagctggctgaggctctggctggtgactctggcctctggtgtagacttccctcaggtgagtgcatggatgagagctctaccttctcctgactgcccaggcctcaggacaacaggagaacagatgcaaaaactattgctcaaggaaaataaagtgaaaacgaggaaaagcaaaagaagatctggagagggctctcacctgaccacaagcatcctggagcaatgagtttcaggcaggaagactcatcctgagctgagctgcttttcttgaagttgtgcaagaacgtcctgttggctggggcaaattcagtatttcttttcctggccactgtgctggagcgtgaggaaagactctccaccctcactcccagatcctgcaggaggcgtgagagcggatggagatggtgaggatgtctattaatatggtgtttcctgcaaaacggtgcccatctcaaccatgggttgtcaaccatcctcggtgtctacaactgcaatttacctttgaggacccactctgtcagcatggacatcctttttctttttccctggtaaggacatcagaaagaaagttacccctccagtgtttggagtcttggaatccttggcctgcctgcaggcctctgaatcctcagtgtgttagcccaaggtcaccttaggtaaaggaacatttctcctggtcttccaacaccctggaaagggaggctcttcaagaataggaaattcttcctagtatctaaccttggcctgcaactatgccatacatttaattgtagaaggtatggaaagttaggactgtggtggacccagttaaatcactggacagaagccatgaggcagagccagaaccagcttctggactccctgcatggagctttctactatcccaggttgttgggtcccttctcagtggccaaagatgctattttatgagccttgaggacatgacactaagtgaaaaaagcctggccaaagggccacatagtgtatagttctatttatatgaaatgtccaggaaagacaaaagcatagaggcagaaagcagactagtgctgtgggaggaatgggggatttgggaggtgatggctaaggggttatggggttttgggggaggtaatagaaatgttttaaaattggttgtgaaggtggatgcccaactctgcgaatacactaaaaggcatcgaattgtatactttaaataggtgaattgtatgctatgtgaattatatctcaataaaggtattttttccctgcnnnnnnnnnn

SEQ ID NO: 286952 - DNA, 616 bp, Homo sapiens
aactaaggtaagtcttctgcatttgcatttgaaaatgaatgtggcagattctagagtgcctcagtaccctttctctccataatgttccttctgcatagcgttttatggttcttcactctctcagtttcaggcaggaagactcatcctgagctgagctgcttttcttgaagttgtgcaagaacgtcctgttggctggggcaaattcagtatttcttttcctggccactgtgctggagcgtgaggaaagactctccaccctcactcccagatcctgcaggaggcgtgagagcggatggagatggtgaggatgtctattaatatggtgtttcctgcaaaacggtgcccatctcaaccatgggttgtcaaccatcctcggtgtctacaactgcaatttacctttgagggcccatgaactctgattacctgaaagtccttaggccagaaagagaaacccctgtcccccacctctcactttcacctatttctagaccttttcttacagcaatgccttggccctcaggaagcatcagatctcaaactgcagggtctggggctgaagctgatgctggcatgggtgactcagagttcctctattagttcaaatatgtaatatctt

SEQ ID NO: 286953 - DNA, 2591 bp, Homo sapiens
  misc_feature (130)..(130): n is a, c, g, or t
agttctactgcccgctttagcacagtggctgcagctgtgctctgcgggtccctgccctcaagcccggacttcgcccataattctggaagttctcctccgcctcaaccccaggatgaagttgaagcgggtnctctgcgcttccgggaagtggtcatgtgataccccaggcgcctgcgctctctttctagggactttcctgagtgggagggatttcgccggaacaaaaatgcctcagtttggaggtcgcgctcactgcgacggcaggctttgagtgtagcacttggtagttcttcctctgctctgcttcccttcggaggaaaatttcaggctgaaggtttagcgggtgccgcctctaaagagagcaatcactacacttatggctgggattttgcgcttagtagttcaatggcccccaggcagactacagaccgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccaacagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatggtgagaaagtgttttcattaaaatatgttttcaaaaccattttcaggccgggcacggtggctcacctgtaatcccagcactttgggaggccaaggcgggcagatcacctgaggtcaagagttcgagaccagcctgaccaacatggagaaacccccatctctactgaaaatacagaattagccaggcatggtggcacatgcctgtaacccagctactcgggaggctgaagcaggagaatcacttgaacccgggaggcagaggttgcagtgagctgagatggtgccactgtactccagcctgggtgataggatgagactccatctcaggggaaaaaaaaaaatttttttttcactgactaaacctgctgcagctctcttttactacagacttggagattttagtttaatttggtttaattctctgtcctttccctttcactgtttcactccaaaacatgtaagaatggcaatgtttgaacatctgcgtttgggtctactgccaccttagcaagcctcattaaccattttataaaaattgcgttagtattgttgttgttgtttttgagacagggtcttgctctgtcacccaagctggaatacagtggcatgatttcagttcactgcggcctcgacctcccaggctcaagtgatcctcccacctcagcctccagagtagctgggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctatttcagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggca

SEQ ID NO: 286954 - DNA, 502 bp, Homo sapiens
gattgctgcaacgactctcttaacatccaccgctacagaatcaagcccttgaagttgccacaaggacttccaacagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaatcagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggca

SEQ ID NO: 286955 - DNA, 526 bp, Homo sapiens
  misc_feature (130)..(130): n is a, c, g, or t
agttctactgcccgctttagcacagtggctgcagctgtgctctgcgggtccctgccctcaagcccggacttcgcccataattctggaagttctcctccgcctcaaccccaggatgaagttgaagcgggtnctctgcgcttccgggaagtggtcatgtgataccccaggcgcctgcgctctctttctagggactttcctgagtgggagggatttcgccggaacaaaaatgcctcagtttggaggtcgcgctcactgcgacggcaggctttgagtgtagcacttggtagttcttcctctgctctgcttcccttcggaggaaaatttcaggctgaaggtttagcgggtgccggtgagtggggaatgagtggcggagagtgcggcattcttcgcaaggtgtatccgggaaccctctgcagatcctaattgattttccctattgcgtactgaattggccggttacggcaacctaaatgggtctgcccctgatcccgtcacattggctcccgtaaggccattggcctgcagg

SEQ ID NO: 286956 - DNA, 334 bp, Homo sapiens
tacgtgttcaggtgcttagaacagcttcttgcatcttttctcacatgatgcctttttaatgaggcttagcctaacaaccctatttaaaattgcaatgtaagttttctcacatacacagttacaatcctccctttatcagctctacatttttttttaatagactgaatctcgctctgttgcccagcccatctcggcccactgaaacctccacctcccgggttcaagcgattctcctgcctcagcctcccgatgctttaggaggccaaggcaggaggactgcttgagcccaggagtttgagaccagcctggacaacaaagtgagattcatctctac

SEQ ID NO: 286957 - DNA, 2781 bp, Homo sapiens
  misc_feature (130)..(130): n is a, c, g, or t
agttctactgcccgctttagcacagtggctgcagctgtgctctgcgggtccctgccctcaagcccggacttcgcccataattctggaagttctcctccgcctcaaccccaggatgaagttgaagcgggtnctctgcgcttccgggaagtggtcatgtgataccccaggcgcctgcgctctctttctagggactttcctgagtgggagggatttcgccggaacaaaaatgcctcagtttggaggtcgcgctcactgcgacggcaggctttgagtgtagcacttggtagttcttcctctgctctgcttcccttcggaggaaaatttcaggctgaaggtttagcgggtgccgcctctaaagagagcaatcactacacttatggctgggattttgcgcttagtagttcaatggcccccaggcagactacagaccgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccaacagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatggtgagaaagtgttttcattaaaatatgttttcaaaaccattttcaggccgggcacggtggctcacctgtaatcccagcactttgggaggccaaggcgggcagatcacctgaggtcaagagttcgagaccagcctgaccaacatggagaaacccccatctctactgaaaatacagaattagccaggcatggtggcacatgcctgtaacccagctactcgggaggctgaagcaggagaatcacttgaacccgggaggcagaggttgcagtgagctgagatggtgccactgtactccagcctgggtgataggatgagactccatctcaggggaaaaaaaaaaatttttttttcactgactaaacctgctgcagctctcttttactacagacttggagattttagtttaatttggtttaattctctgtcctttccctttcactgtttcactccaaaacatgtaagaatggcaatgtttgaacatctgcgtttgggtctactgccaccttagcaagcctcattaaccattttataaaaattgcgttagtattgttgttgttgtttttgagacagggtcttgctctgtcacccaagctggaatacagtggcatgatttcagttcactgcggcctcgacctcccaggctcaagtgatcctcccacctcagcctccagagtagctgggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctatttcagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggcaactgcagttttaattccatagttattgaatatccagtgtgtgtaaggcctggaggggagccaaaggacactaacttctaagagctccgtctagttggagagaaacctgtgtgccacaacatacagtgtccttgcttatgtggggtcgaagacatctgtgaaaataaaagcagcctctgctaatttagcgc

SEQ ID NO: 286958 - DNA, 4103 bp, Homo sapiens
  misc_feature (130)..(130): n is a, c, g, or t
agttctactgcccgctttagcacagtggctgcagctgtgctctgcgggtccctgccctcaagcccggacttcgcccataattctggaagttctcctccgcctcaaccccaggatgaagttgaagcgggtnctctgcgcttccgggaagtggtcatgtgataccccaggcgcctgcgctctctttctagggactttcctgagtgggagggatttcgccggaacaaaaatgcctcagtttggaggtcgcgctcactgcgacggcaggctttgagtgtagcacttggtagttcttcctctgctctgcttcccttcggaggaaaatttcaggctgaaggtttagcgggtgccgcctctaaagagagcaatcactacacttatggctgggattttgcgcttagtagttcaatggcccccaggcagactacagaccgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccaacagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatggtgagaaagtgttttcattaaaatatgttttcaaaaccattttcaggccgggcacggtggctcacctgtaatcccagcactttgggaggccaaggcgggcagatcacctgaggtcaagagttcgagaccagcctgaccaacatggagaaacccccatctctactgaaaatacagaattagccaggcatggtggcacatgcctgtaacccagctactcgggaggctgaagcaggagaatcacttgaacccgggaggcagaggttgcagtgagctgagatggtgccactgtactccagcctgggtgataggatgagactccatctcaggggaaaaaaaaaaatttttttttcactgactaaacctgctgcagctctcttttactacagacttggagattttagtttaatttggtttaattctctgtcctttccctttcactgtttcactccaaaacatgtaagaatggcaatgtttgaacatctgcgtttgggtctactgccaccttagcaagcctcattaaccattttataaaaattgcgttagtattgttgttgttgtttttgagacagggtcttgctctgtcacccaagctggaatacagtggcatgatttcagttcactgcggcctcgacctcccaggctcaagtgatcctcccacctcagcctccagagtagctgggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctatttcagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggcaactgcagttttaattccatagttattgaatatccagtgtgtgtaaggcctggaggggagccaaaggacactaacttctaagagctccgtctagttggagagaaacctgtgtgccacaacatacagtgtccttgcttatgtggggtcgaagacatctgtgaaaataaaagcagcctctgctaatttagcgccatctcttttactgtgctaatttttttttctttagagacagggtctcactctgtcgcccagcctggagggcagtggtgtgatcgtagctcactattacctccaactcttgggctcaagtgatcctcccacctcagcctcctgagcagctaggactacagatacatgccaccgctcccggctagtattttttaaaattttttgtagagccaagtgttgctatgttgtccacactgatctggagcttctaatctcaaatgattctcctgcctcagcctcccaaagtgctgggaatacaggtgtgagccaccatacctggccttactgtactaatattaatattgtgtaaataggggaaaataccatggttaatttttactcaaacagtaagaaagtttgagtaactaattttaatctcaacagcccatagctagaagaggggatctaaatgttaagttgaatatttagaaataaaagtgtctacaagaagaaaagtctttagtgaaaatatgggcataggccagcagcattagctttctattgctgcagaacaaattaccacaaacttagctgcttaaaacaacacacacttattgtctcacaatgtttgtgggtcggaagtctaggcgtggcttagctgggtagtctgtttaggattcatggcaagttgcttcttccaaaaccagcattggagacagactagcaagatgggcactacactcttagataatcaaataaatgcaatcatgtgcctcgtgtcaccttttttgcattccattcattaagaacaagttgcagttcctacctacactcaaggaagggaggaattacacagaagtgtgaccacaggaggcagggctcatggaggcctccttaaagtcccccagccaaacctgaaaagtcaatcctggaccttatcatagtggctgtatagtttagaaggtttcttcagattggcattcctttgcctcatatcatcacttcaaaaccctataagggtttgttcctcggtcttgactttgtgtctttgaggattgctttgtttagtgtcacctgccttctttcaggaggttttgcctgacatctggtggtgaccgtggccaccaagtcaacccaaacactacctttaaggacgactgcagttctcttagggtctcctcaatctaaaattgtacctctttcaggccaaacacctattttcttcattttttttctcataagaatgctagctagtatgcctaattatctaactggcacagtttcaccaaggacagtttggaactacacaggccattttagggagattttgacatgaacaagattg

SEQ ID NO: 286959 - DNA, 2583 bp, Homo sapiens
  misc_feature (130)..(130): n is a, c, g, or t
agttctactgcccgctttagcacagtggctgcagctgtgctctgcgggtccctgccctcaagcccggacttcgcccataattctggaagttctcctccgcctcaaccccaggatgaagttgaagcgggtnctctgcgcttccgggaagtggtcatgtgataccccaggcgcctgcgctctctttctagggactttcctgagtgggagggatttcgccggaacaaaaatgcctcagtttggaggtcgcgctcactgcgacggcaggctttgagtgtagcacttggtagttcttcctctgctctgcttcccttcggaggaaaatttcaggctgaaggtttagcgggtgccgcctctaaagagagcaatcactacacttatggctgggattttgcgcttagtagttcaatggcccccaggcagactacagaccgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccaacagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatggtgagaaagtgttttcattaaaatatgttttcaaaaccattttcaggccgggcacggtggctcacctgtaatcccagcactttgggaggccaaggcgggcagatcacctgaggtcaagagttcgagaccagcctgaccaacatggagaaacccccatctctactgaaaatacagaattagccaggcatggtggcacatgcctgtaacccagctactcgggaggctgaagcaggagaatcacttgaacccgggaggcagaggttgcagtgagctgagatggtgccactgtactccagcctgggtgataggatgagactccatctcaggggaaaaaaaaaaatttttttttcactgactaaacctgctgcagctctcttttactacagacttggagattttagtttaatttggtttaattctctgtcctttccctttcactgtttcactccaaaacatgtaagaatggcaatgtttgaacatctgcgtttgggtctactgccaccttagcaagcctcattaaccattttataaaaattgcgttagtattgttgttgttgtttttgagacagggtcttgctctgtcacccaagctggaatacagtggcatgatttcagttcactgcggcctcgacctcccaggctcaagtgatcctcccacctcagcctccagagtagctgggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctatttcagatacctggaggggtggggagaagtagatgtacggagtcagtaggggatcgtacagtgatgaatgagatgaagaactctgatttagtacctggtccttacttgtaaatgggtgtgaatggctgttgtttggtcaatcacggggaactacgttgggcgggtaaggagagtgccaggacaacttaaaggaggggacaatggtccgggggggggaaaataagctgaaaggtaattctgtggaaattaaaaggggttttgttatttaggatgtaaagc

SEQ ID NO: 286960 - DNA, 2531 bp, Homo sapiens
  misc_feature (130)..(130): n is a, c, g, or t
agttctactgcccgctttagcacagtggctgcagctgtgctctgcgggtccctgccctcaagcccggacttcgcccataattctggaagttctcctccgcctcaaccccaggatgaagttgaagcgggtnctctgcgcttccgggaagtggtcatgtgataccccaggcgcctgcgctctctttctagggactttcctgagtgggagggatttcgccggaacaaaaatgcctcagtttggaggtcgcgctcactgcgacggcaggctttgagtgtagcacttggtagttcttcctctgctctgcttcccttcggaggaaaatttcaggctgaaggtttagcgggtgccgcctctaaagagagcaatcactacacttatggctgggattttgcgcttagtagttcaatggcccccaggcagactacagaccgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccaacagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatggtgagaaagtgttttcattaaaatatgttttcaaaaccattttcaggccgggcacggtggctcacctgtaatcccagcactttgggaggccaaggcgggcagatcacctgaggtcaagagttcgagaccagcctgaccaacatggagaaacccccatctctactgaaaatacagaattagccaggcatggtggcacatgcctgtaacccagctactcgggaggctgaagcaggagaatcacttgaacccgggaggcagaggttgcagtgagctgagatggtgccactgtactccagcctgggtgataggatgagactccatctcaggggaaaaaaaaaaatttttttttcactgactaaacctgctgcagctctcttttactacagacttggagattttagtttaatttggtttaattctctgtcctttccctttcactgtttcactccaaaacatgtaagaatggcaatgtttgaacatctgcgtttgggtctactgccaccttagcaagcctcattaaccattttataaaaattgcgttagtattgttgttgttgtttttgagacagggtcttgctctgtcacccaagctggaatacagtggcatgatttcagttcactgcggcctcgacctcccaggctcaagtgatcctcccacctcagcctccagagtagctgggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgtcagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggca

SEQ ID NO: 286961 - DNA, 2555 bp, Homo sapiens
cggcacgagggtttagcgggtgccctctaaagagagcaatcactacacttatggctgggattttgcgcttagtagttcaatggcccccaggcagactacaggcttgcttttagaaagtgcagtggtgctgcctaatctgctcataagggccagagcctagatgagcctattgacctgctcctggctgcagaggacaacaataccgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccaacagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatggtgagaaagtgttttcattaaaatatgttttcaaaaccattttcaggccgggcacggtggctcacctgtaatcccagcactttgggaggccaaggcgggcagatcacctgaggtcaagagttcgagaccagcctgaccaacatggagaaacccccatctctactgaaaatacagaattagccaggcatggtggcacatgcctgtaacccagctactcgggaggctgaagcaggagaatcacttgaacccgggaggcagaggttgcagtgagctgagatggtgccactgtactccagcctgggtgataggatgagactccatctcaggggaaaaaaaaaaatttttttttcactgactaaacctgctgcagctctcttttactacagacttggagattttagtttaatttggtttaattctctgtcctttccctttcactgtttcactccaaaacatgtaagaatggcaatgtttgaacatctgcgtttgggtctactgccaccttagcaagcctcattaaccattttataaaaattgcgttagtattgttgttgttgtttttgagacagggtcttgctctgtcacccaagctggaatacagtggcatgatttcagttcactgcggcctcgacctcccaggctcaagtgatcctcccacctcagcctccagagtagctgggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctatttcagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggcaactgcagttttaattccatagttattgaatatccagtgtgtgtaaggcctggaggggagccaaaggacactaacttctaagagctccgtctagttggagagaaacctgtgtgccacaacatacagtgtccttgcttatgtggggtcgaagacatctgtgaaaataaaagcagcctctgctaatttagcgc

SEQ ID NO: 286962 - DNA, 3164 bp, Homo sapiens
  misc_feature (130)..(130): n is a, c, g, or t
agttctactgcccgctttagcacagtggctgcagctgtgctctgcgggtccctgccctcaagcccggacttcgcccataattctggaagttctcctccgcctcaaccccaggatgaagttgaagcgggtnctctgcgcttccgggaagtggtcatgtgataccccaggcgcctgcgctctctttctagggactttcctgagtgggagggatttcgccggaacaaaaatgcctcagtttggaggtcgcgctcactgcgacggcaggctttgagtgtagcacttggtagttcttcctctgctctgcttcccttcggaggaaaatttcaggctgaaggtttagcgggtgccgcctctaaagagagcaatcactacacttatggctgggattttgcgcttagtagttcaatggcccccaggcagactacagaccgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataaggtttgttgtttcttctcagctctttttaaaatgtattgcctagtgtaattctaaatgcatttttcttttttcgttaatgttctgaaaaaaactttttaaaaaactaaaattttattttgtttttttttaattgacacataataattgtacatatttatggggtacatagtgacgtttcaatatatataaagtatagtgatccgatcagggtaattggcatatccatcatctcagacatttaccatttcttcatgttgggaacattcaacatcctcctcctagctatttgaaactatgtgttattgttaactgtagttatcctgcggggatatagaacgctagaacgtattcctcctatctaaacgcattttcttgtgtcacagaatcaagcccttgaagttgccacaaggacttccaacagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatggtgagaaagtgttttcattaaaatatgttttcaaaaccattttcaggccgggcacggtggctcacctgtaatcccagcactttgggaggccaaggcgggcagatcacctgaggtcaagagttcgagaccagcctgaccaacatggagaaacccccatctctactgaaaatacagaattagccaggcatggtggcacatgcctgtaacccagctactcgggaggctgaagcaggagaatcacttgaacccgggaggcagaggttgcagtgagctgagatggtgccactgtactccagcctgggtgataggatgagactccatctcaggggaaaaaaaaaaatttttttttcactgactaaacctgctgcagctctcttttactacagacttggagattttagtttaatttggtttaattctctgtcctttccctttcactgtttcactccaaaacatgtaagaatggcaatgtttgaacatctgcgtttgggtctactgccaccttagcaagcctcattaaccattttataaaaattgcgttagtattgttgttgttgtttttgagacagggtcttgctctgtcacccaagctggaatacagtggcatgatttcagttcactgcggcctcgacctcccaggctcaagtgatcctcccacctcagcctccagagtagctgggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctatttcagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggcaactgcagttttaattccatagttattgaatatccagtgtgtgtaaggcctggaggggagccaaaggacactaacttctaagagctccgtctagttggagagaaacctgtgtgccacaacatacagtgtccttgcttatgtggggtcgaagacatctgtgaaaataaaagcagcctctgctaatttagcgc

SEQ ID NO: 286963 - DNA, 1561 bp, Homo sapiens
gactagttctagatcgcgagcggccgcccaaaatttttttttcactgactaaacctgctgcagctctcttttactacagacttggagattttagtttaatttggtttaattctctgtcctttccctttcactgtttcactccaaaacatgtaagaatggcaatgtttgaacatctgcgtttgggtctactgccaccttagcaagcctcattaaccattttataaaaattgcgttagtattgttgttgttgtttttgagacagggtcttgctctgtcacccaagctggaatacagtggcatgatttcagttcactgcggcctcgacctcccaggctcaagtgatcctcccacctcagcctccagagtagctgggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctatttcagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggcaactgcagttttaattccatagttattgaatatccagtgtgtgtaaggcctggaggggagccaaaggacactaacttctaagagctccgtctagttggagagaaacctgtgtgccacaacatacagtgtccttgcttatgtggggtcgaagacatctgtgaaaataaaagcagcctctgctaatttagcgc

SEQ ID NO: 286964 - DNA, 3721 bp, Homo sapiens
  misc_feature (130)..(130): n is a, c, g, or t
agttctactgcccgctttagcacagtggctgcagctgtgctctgcgggtccctgccctcaagcccggacttcgcccataattctggaagttctcctccgcctcaaccccaggatgaagttgaagcgggtnctctgcgcttccgggaagtggtcatgtgataccccaggcgcctgcgctctctttctagggactttcctgagtgggagggatttcgccggaacaaaaatgcctcagtttggaggtcgcgctcactgcgacggcaggctttgagtgtagcacttggtagttcttcctctgctctgcttcccttcggaggaaaatttcaggctgaaggtttagcgggtgccggtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccaacagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatggtgagaaagtgttttcattaaaatatgttttcaaaaccattttcaggccgggcacggtggctcacctgtaatcccagcactttgggaggccaaggcgggcagatcacctgaggtcaagagttcgagaccagcctgaccaacatggagaaacccccatctctactgaaaatacagaattagccaggcatggtggcacatgcctgtaacccagctactcgggaggctgaagcaggagaatcacttgaacccgggaggatacagtggcatgatttcagttcactgcggcctcgacctcccaggctcaagtgatcctcccacctcagcctccagagtagctgggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctatttcagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggcaactgcagttttaattccatagttattgaatatccagtgtgtgtaaggcctggaggggagccaaaggacactaacttctaagagctccgtctagttggagagaaacctgtgtgccacaacatacagtgtccttgcttatgtggggtcgaagacatctgtgaaaataaaagcagcctctgctaatttagcgccatctcttttactgtgctaatttttttttctttagagacagggtctcactctgtcgcccagcctggagggcagtggtgtgatcgtagctcactattacctccaactcttgggctcaagtgatcctcccacctcagcctcctgagcagctaggactacagatacatgccaccgctcccggctagtattttttaaaattttttgtagagccaagtgttgctatgttgtccacactgatctggagcttctaatctcaaatgattctcctgcctcagcctcccaaagtgctgggaatacaggtgtgagccaccatacctggccttactgtactaatattaatattgtgtaaataggggaaaataccatggttaatttttactcaaacagtaagaaagtttgagtaactaattttaatctcaacagcccatagctagaagaggggatctaaatgttaagttgaatatttagaaataaaagtgtctacaagaagaaaagtctttagtgaaaatatgggcataggccagcagcattagctttctattgctgcagaacaaattaccacaaacttagctgcttaaaacaacacacacttattgtctcacaatgtttgtgggtcggaagtctaggcgtggcttagctgggtagtctgtttaggatctcagtgctggaaaaacgtgtctggccaggtgctcattgtagctttgacagggaagggatctgctcccaagcactctcaggttgttggcagaatttgtttccttatggctgtaggattcatggcaagttgcttcttccaaaaccagcattggagacagactagcaagatgggcactacactcttagataatcaaataaatgcaatcatgtgcctcgtgtcaccttttttgcattccattcattaagaacaagttgcagttcctacctacactcaaggaagggaggaattacacagaagtgtgaccacaggaggcagggctcatggaggcctccttaaagtcccccagccaaacctgaaaagtcaatcctggaccttatcatagtggctgtatagtttagaaggtttcttcagattggcattcctttgcctcatatcatcacttcaaaaccctataagggtttgttcctcggtcttgactttgtgtctttgaggattgctttgtttagtgtcacctgccttctttcaggaggttttgcctgacatctggtggtgaccgtggccaccaagtcaacccaaacactacctttaaggacgactgcagttctcttagggtctcctcaatctaaaattgtacctctttcaggccaaacacctattttcttcattttttttctcataagaatgctagctagtatgcctaattatctaactggcacagtttcaccaaggacagtttggaactacacaggccattttagggagattttgacatgaacaagattg

SEQ ID NO: 286965 - DNA, 3367 bp, Homo sapiens
  misc_feature (130)..(130): n is a, c, g, or t
agttctactgcccgctttagcacagtggctgcagctgtgctctgcgggtccctgccctcaagcccggacttcgcccataattctggaagttctcctccgcctcaaccccaggatgaagttgaagcgggtnctctgcgcttccgggaagtggtcatgtgataccccaggcgcctgcgctctctttctagggactttcctgagtgggagggatttcgccggaacaaaaatgcctcagtttggaggtcgcgctcactgcgacggcaggctttgagtgtagcacttggtagttcttcctctgctctgcttcccttcggaggaaaatttcaggctgaaggtttagcgggtgccgcctctaaagagagcaatcactacacttatggctgggattttgcgcttagtagttcaatggcccccaggcagactacagaccgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaaatacagtggcatgatttcagttcactgcggcctcgacctcccaggctcaagtgatcctcccacctcagcctccagagtagctgggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctatttcagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggcaactgcagttttaattccatagttattgaatatccagtgtgtgtaaggcctggaggggagccaaaggacactaacttctaagagctccgtctagttggagagaaacctgtgtgccacaacatacagtgtccttgcttatgtggggtcgaagacatctgtgaaaataaaagcagcctctgctaatttagcgccatctcttttactgtgctaatttttttttctttagagacagggtctcactctgtcgcccagcctggagggcagtggtgtgatcgtagctcactattacctccaactcttgggctcaagtgatcctcccacctcagcctcctgagcagctaggactacagatacatgccaccgctcccggctagtattttttaaaattttttgtagagccaagtgttgctatgttgtccacactgatctggagcttctaatctcaaatgattctcctgcctcagcctcccaaagtgctgggaatacaggtgtgagccaccatacctggccttactgtactaatattaatattgtgtaaataggggaaaataccatggttaatttttactcaaacagtaagaaagtttgagtaactaattttaatctcaacagcccatagctagaagaggggatctaaatgttaagttgaatatttagaaataaaagtgtctacaagaagaaaagtctttagtgaaaatatgggcataggccagcagcattagctttctattgctgcagaacaaattaccacaaacttagctgcttaaaacaacacacacttattgtctcacaatgtttgtgggtcggaagtctaggcgtggcttagctgggtagtctgtttaggatctcagtgctggaaaaacgtgtctggccaggtgctcattgtagctttgacagggaagggatctgctcccaagcactctcaggttgttggcagaatttgtttccttatggctgtaggattcatggcaagttgcttcttccaaaaccagcattggagacagactagcaagatgggcactacactcttagataatcaaataaatgcaatcatgtgcctcgtgtcaccttttttgcattccattcattaagaacaagttgcagttcctacctacactcaaggaagggaggaattacacagaagtgtgaccacaggaggcagggctcatggaggcctccttaaagtcccccagccaaacctgaaaagtcaatcctggaccttatcatagtggctgtatagtttagaaggtttcttcagattggcattcctttgcctcatatcatcacttcaaaaccctataagggtttgttcctcggtcttgactttgtgtctttgaggattgctttgtttagtgtcacctgccttctttcaggaggttttgcctgacatctggtggtgaccgtggccaccaagtcaacccaaacactacctttaaggacgactgcagttctcttagggtctcctcaatctaaaattgtacctctttcaggccaaacacctattttcttcattttttttctcataagaatgctagctagtatgcctaattatctaactggcacagtttcaccaaggacagtttggaactacacaggccattttagggagattttgacatgaacaagattg

SEQ ID NO: 286966 - DNA, 2534 bp, Homo sapiens
ggtacctccaggctgattgcaggcttccaggcttgattgcgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctatttcagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggcaactgcagttttaattccatagttattgaatatccagtgtgtgtaaggcctggaggggagccaaaggacactaacttctaagagctccgtctagttggagagaaacctgtgtgccacaacatacagtgtccttgcttatgtggggtcgaagacatctgtgaaaataaaagcagcctctgctaatttagcgccatctcttttactgtgctaatttttttttctttagagacagggtctcactctgtcgcccagcctggagggcagtggtgtgatcgtagctcactattacctccaactcttgggctcaagtgatcctcccacctcagcctcctgagcagctaggactacagatacatgccaccgctcccggctagtattttttaaaattttttgtagagccaagtgttgctatgttgtccacactgatctggagcttctaatctcaaatgattctcctgcctcagcctcccaaagtgctgggaatacaggtgtgagccaccatacctggccttactgtactaatattaatattgtgtaaataggggaaaataccatggttaatttttactcaaacagtaagaaagtttgagtaactaattttaatctcaacagcccatagctagaagaggggatctaaatgttaagttgaatatttagaaataaaagtgtctacaagaagaaaagtctttagtgaaaatatgggcataggccagcagcattagctttctattgctgcagaacaaattaccacaaacttagctgcttaaaacaacacacacttattgtctcacaatgtttgtgggtcggaagtctaggcgtggcttagctgggtagtctgtttaggatctcagtgctggaaaaacgtgtctggccaggtgctcattgtagctttgacagggaagggatctgctcccaagcactctcaggttgttggcagaatttgtttccttatggctgtaggattcatggcaagttgcttcttccaaaaccagcattggagacagactagcaagatgggcactacactcttagataatcaaataaatgcaatcatgtgcctcgtgtcaccttttttgcattccattcattaagaacaagttgcagttcctacctacactcaaggaagggaggaattacacagaagtgtgaccacaggaggcagggctcatggaggcctccttaaagtcccccagccaaacctgaaaagtcaatcctggaccttatcatagtggctgtatagtttagaaggtttcttcagattggcattcctttgcctcatatcatcacttcaaaaccctataagggtttgttcctcggtcttgactttgtgtctttgaggattgctttgtttagtgtcacctgccttctttcaggaggttttgcctgacatctggtggtgaccgtggccaccaagtcaacccaaacactacctttaaggacgactgcagttctcttagggtctcctcaatctaaaattgtacctctttcaggccaaacacctattttcttcattttttttctcataagaatgctagctagtatgcctaattatctaactggcacagtttcaccaaggacagtttggaactacacaggccattttagggagattttgacatgaacaagattg

SEQ ID NO: 286967 - DNA, 2822 bp, Homo sapiens
  misc_feature (130)..(130): n is a, c, g, or t
agttctactgcccgctttagcacagtggctgcagctgtgctctgcgggtccctgccctcaagcccggacttcgcccataattctggaagttctcctccgcctcaaccccaggatgaagttgaagcgggtnctctgcgcttccgggaagtggtcatgtgataccccaggcgcctgcgctctctttctagggactttcctgagtgggagggatttcgccggaacaaaaatgcctcagtttggaggtcgcgctcactgcgacggcaggctttgagtgtagcacttggtagttcttcctctgctctgcttcccttcggaggaaaatttcaggctgaaggtttagcgggtgccgcctctaaagagagcaatcactacacttatggctgggattttgcgcttagtagttcaatggcccccaggcagactacagaccgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccaacagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaatcagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggcaactgcagttttaattccatagttattgaatatccagtgtgtgtaaggcctggaggggagccaaaggacactaacttctaagagctccgtctagttggagagaaacctgtgtgccacaacatacagtgtccttgcttatgtggggtcgaagacatctgtgaaaataaaagcagcctctgctaatttagcgccatctcttttactgtgctaatttttttttctttagagacagggtctcactctgtcgcccagcctggagggcagtggtgtgatcgtagctcactattacctccaactcttgggctcaagtgatcctcccacctcagcctcctgagcagctaggactacagatacatgccaccgctcccggctagtattttttaaaattttttgtagagccaagtgttgctatgttgtccacactgatctggagcttctaatctcaaatgattctcctgcctcagcctcccaaagtgctgggaatacaggtgtgagccaccatacctggccttactgtactaatattaatattgtgtaaataggggaaaataccatggttaatttttactcaaacagtaagaaagtttgagtaactaattttaatctcaacagcccatagctagaagaggggatctaaatgttaagttgaatatttagaaataaaagtgtctacaagaagaaaagtctttagtgaaaatatgggcataggccagcagcattagctttctattgctgcagaacaaattaccacaaacttagctgcttaaaacaacacacacttattgtctcacaatgtttgtgggtcggaagtctaggcgtggcttagctgggtagtctgtttaggatctcagtgctggaaaaacgtgtctggccaggtgctcattgtagctttgacagggaagggatctgctcccaagcactctcaggttgttggcagaatttgtttccttatggctgtaggattcatggcaagttgcttcttccaaaaccagcattggagacagactagcaagatgggcactacactcttagataatcaaataaatgcaatcatgtgcctcgtgtcaccttttttgcattccattcattaagaacaagttgcagttcctacctacactcaaggaagggaggaattacacagaagtgtgaccacaggaggcagggctcatggaggcctccttaaagtcccccagccaaacctgaaaagtcaatcctggaccttatcatagtggctgtatagtttagaaggtttcttcagattggcattcctttgcctcatatcatcacttcaaaaccctataagggtttgttcctcggtcttgactttgtgtctttgaggattgctttgtttagtgtcacctgccttctttcaggaggttttgcctgacatctggtggtgaccgtggccaccaagtcaacccaaacactacctttaaggacgactgcagttctcttagggtctcctcaatctaaaattgtacctctttcaggccaaacacctattttcttcattttttttctcataagaatgctagctagtatgcctaattatctaactggcacagtttcaccaaggacagtttggaactacacaggccattttagggagattttgacatgaacaagattg

SEQ ID NO: 286968 - DNA, 1595 bp, Homo sapiens
agcgcgtgggcggccgtggggtcttgggcgcgcgcggtgtttctggcggtgggtcaggacttgcgggtcgcctccgccggtgttgaagcctcttgtgtgcacactttctcctcagcacttgggacgacctaatttcactgttaggaacggttgatcccgaacacaggagggagggtaaatatcgtaaaacatgttggacgctagctgtgtgcacgccccctgggagccaaaagggcgaagtaaaacatgcacacgaccgtaatgagattctgaactgaatctcgctctgttgcccagcccatctcggcccactgaaacctccacctcccgggttcaagcgattctcctgcctcagcctcccgagtagctgagattacaggcgcccgccaccacgcccagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtctaccatgatatgggtaatatcaatttgactttctttacaaccaaaaaaaagtatgatagaatggaaaatctgaaattaattgtgagagctctgaatgctgtccaaccccagctggatgtgcaggctaccaaaagatttgaccttttacttgatggacagtttaaaatctcaggaacagcttctaagatcggccggactactgcctatcaccattgcactttattatgtagtactgatgggacgttcctgtcttctttgctaaagagcccttaccaagggatcaggagcaatgccactgctagcataccttccttagtgaaaaatcttttggaaaaggatcccactctgacctgtgaagtactaatgaatgctgttgctacagagtatgctgcctatcatcaaattgataatcacattcacctaataaacccaacggatgagacactgtttcctggaataaatagcaaagccaaagaactgcaaacttgggagtggatatatggcaaaactccaaagtttagtataaatacttcctttcatgtgttatatgaacagtcacacttggaaattaaagtattcatagacataaagaatggaagaattgaaatttgtaatattgaagcacctgatcattggttgccattggaaatacgtgacaaattaaattcaagtcttattggcagtaagttttgcccaactgaaactaccatgctaacaaatatattacttagaacatgtccacaagaccacaaactaaacagtaaatggaatattctctgtgaaaaaattaagggaataatgtgattccaagtaaatgtcttaatacagtttcaattagaaaataaaatgtctcatacttgcacattgtatgtcaaaa

SEQ ID NO: 286969 - DNA, 1293 bp, Homo sapiens
agcatcgcgcgcaaggcctgccggttgctcggggtcgtatgacgcacttttccagctcgagccctcacgaggccgtgggtacgaccggaagccgcagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtctaccatgatatgggtaatatcaatttgactttctttacaaccaaaaaaaagtatgatagaatggaaaatctgaaattaattgtgagagctctgaatgctgtccaaccccagctggatgtgcaggctaccaaaagatttgaccttttacttgatggacagtttaaaatctcaggaacagcttctaagatcggccggactactgcctatcaccattgcactttattatgtagtactgatgggacgttcctgtcttctttgctaaagagcccttaccaagggatcaggagcaatgccactgctagcataccttccttagtgaaaaatcttttggaaaaggatcccactctgacctgtgaagtactaatgaatgctgttgctacagagtatgctgcctatcatcaaattgataatcacattcacctaataaacccaacggatgagacactgtttcctggaataaatagcaaagccaaagaactgcaaacttgggagtggatatatggcaaaactccaaagtttagtataaatacttcctttcatgtgttatatgaacagtcacacttggaaattaaagtattcatagacataaagaatggaagaattgaaatttgtaatattgaagcacctgatcattggttgccattggaaatacgtgacaaattaaattcaagtcttattggcagtaagttttgcccaactgaaactaccatgctaacaaatatattacttagaacatgtccacaagaccacaaactaaacagtaaatggaatattctctgtgaaaaaattaagggaataatgtgattccaagtaaatgtcttaatacagtttcaattagaaaataaaatgtctcatacttgcacattgtatgtcaaaa

SEQ ID NO: 286970 - DNA, 943 bp, Homo sapiens
cccaatggcagccggcccaatggcagccgaaaactggctcggagaagaagtggaggaggaacagtctaccatgatatgggtaatatcaatttgactttctttacaaccaaaaaaaagtatgatagaatggaaaatctgaaattaattgtgagagctctgaatgctgtccaaccccagctggatgtgcaggctaccaaaagatttgaccttttacttgatggacagtttaaaatctcaggaacagcttctaagatcggccggactactgcctatcaccattgcactttattatgtagtactgatgggacgttcctgtcttctttgctaaagagcccttaccaagggatcaggagcaatgccactgctagcataccttccttagtgaaaaatcttttggaaaaggatcccactctgacctgtgaagtactaatgaatgctgttgctacagagtatgctgcctatcatcaaattgataatcacattcacctaataaacccaacggatgagacactgtttcctggaataaatagcaaagccaaagaactgcaaacttgggagtggatatatggcaaaactccaaagtttagtataaatacttcctttcatgtgttatatgaacagtcacacttggaaattaaagtattcatagacataaagaatggaagaattgaaatttgtaatattgaagcacctgatcattggttgccattggaaatacgtgacaaattaaattcaagtcttattggcagtaagttttgcccaactgaaactaccatgctaacaaatatattacttagaacatgtccacaagaccacaaactaaacagtaaatggaatattctctgtgaaaaaattaagggaataatgtgattccaagtaaatgtcttaatacagtttcaattagaaaataaaatgtctcatacttgcacattgtatgtcaaaa

SEQ ID NO: 286971 - DNA, 840 bp, Homo sapiens
  misc_feature (827)..(827): n is a, c, g, or t
agcatcgcgcgcaaggcctgccggttgctcggggtcgtatgacgcacttttccagctcgagccctcacgaggccgtgggtacgaccggaagccgcagactgaatctcgctctgttgcccagcccatctcggcccactgaaacctccacctcccgggttcaagcgattctcctgcctcagcctcccgagtagctgagattacaggcgcccgccaccacgcccagcctctaaagagagcaatcactacacttatggctgggattttgcgcttagtagttcaatggcccccaggcagactacagaccgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccaacagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaattaagagcgagaaggttcataaattgtttaaaccattagccggncgtgtactgatca

SEQ ID NO: 286972 - DNA, 1193 bp, Homo sapiens
  misc_feature (130)..(130): n is a, c, g, or t
agttctactgcccgctttagcacagtggctgcagctgtgctctgcgggtccctgccctcaagcccggacttcgcccataattctggaagttctcctccgcctcaaccccaggatgaagttgaagcgggtnctctgcgcttccgggaagtggtcatgtgataccccaggcgcctgcgctctctttctagggactttcctgagtgggagggatttcgccggaacaaaaatgcctcagtttggaggtcgcgctcactgcgacggcaggctttgagtgtagcacttggtagttcttcctctgctctgcttcccttcggaggaaaatttcaggctgaaggtttagcgggtgccgcctctaaagagagcaatcactacacttatggctgggattttgcgcttagtagttcaatggcccccaggcagactacagaccgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccaacagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaatcagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggca

SEQ ID NO: 286973 - DNA, 1419 bp, Homo sapiens
agcatcgcgcgcaaggcctgccggttgctcggggtcgtatgacgcacttttccagctcgagccctcacgaggccgtgggtacgaccggaagccgcagactgaatctcgctctgttgcccagcccatctcggcccactgaaacctccacctcccgggttcaagcgattctcctgcctcagcctcccgagtagctgagattacaggcgcccgccaccacgcccagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtctaccatgatatgggtaatatcaatttgactttctttacaaccaaaaaaaagtatgatagaatggaaaatctgaaattaattgtgagagctctgaatgctgtccaaccccagctggatgtgcaggctaccaaaagatttgaccttttacttgatggacagtttaaaatctcaggaacagcttctaagatcggccggactactgcctatcaccattgcactttattatgtagtactgatgggacgttcctgtcttctttgctaaagagcccttaccaagggatcaggagcaatgccactgctagcataccttccttagtgaaaaatcttttggaaaaggatcccactctgacctgtgaagtactaatgaatgctgttgctacagagtatgctgcctatcatcaaattgataatcacattcacctaataaacccaacggatgagacactgtttcctggaataaatagcaaagccaaagaactgcaaacttgggagtggatatatggcaaaactccaaagtttagtataaatacttcctttcatgtgttatatgaacagtcacacttggaaattaaagtattcatagacataaagaatggaagaattgaaatttgtaatattgaagcacctgatcattggttgccattggaaatacgtgacaaattaaattcaagtcttattggcagtaagttttgcccaactgaaactaccatgctaacaaatatattacttagaacatgtccacaagaccacaaactaaacagtaaatggaatattctctgtgaaaaaattaagggaataatgtgattccaagtaaatgtcttaatacagtttcaattagaaaataaaatgtctcatacttgcacattgtatgtcaaaa

SEQ ID NO: 286974 - DNA, 4220 bp, Homo sapiens
  misc_feature (130)..(130): n is a, c, g, or t
agttctactgcccgctttagcacagtggctgcagctgtgctctgcgggtccctgccctcaagcccggacttcgcccataattctggaagttctcctccgcctcaaccccaggatgaagttgaagcgggtnctctgcgcttccgggaagtggtcatgtgataccccaggcgcctgcgctctctttctagggactttcctgagtgggagggatttcgccggaacaaaaatgcctcagtttggaggtcgcgctcactgcgacggcaggctttgagtgtagcacttggtagttcttcctctgctctgcttcccttcggaggaaaatttcaggctgaaggtttagcgggtgccgcctctaaagagagcaatcactacacttatggctgggattttgcgcttagtagttcaatggcccccaggcagactacagaccgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccaacagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatggtgagaaagtgttttcattaaaatatgttttcaaaaccattttcaggccgggcacggtggctcacctgtaatcccagcactttgggaggccaaggcgggcagatcacctgaggtcaagagttcgagaccagcctgaccaacatggagaaacccccatctctactgaaaatacagaattagccaggcatggtggcacatgcctgtaacccagctactcgggaggctgaagcaggagaatcacttgaacccgggaggcagaggttgcagtgagctgagatggtgccactgtactccagcctgggtgataggatgagactccatctcaggggaaaaaaaaaaatttttttttcactgactaaacctgctgcagctctcttttactacagacttggagattttagtttaatttggtttaattctctgtcctttccctttcactgtttcactccaaaacatgtaagaatggcaatgtttgaacatctgcgtttgggtctactgccaccttagcaagcctcattaaccattttataaaaattgcgttagtattgttgttgttgtttttgagacagggtcttgctctgtcacccaagctggaatacagtggcatgatttcagttcactgcggcctcgacctcccaggctcaagtgatcctcccacctcagcctccagagtagctgggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctatttcagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggcaactgcagttttaattccatagttattgaatatccagtgtgtgtaaggcctggaggggagccaaaggacactaacttctaagagctccgtctagttggagagaaacctgtgtgccacaacatacagtgtccttgcttatgtggggtcgaagacatctgtgaaaataaaagcagcctctgctaatttagcgccatctcttttactgtgctaatttttttttctttagagacagggtctcactctgtcgcccagcctggagggcagtggtgtgatcgtagctcactattacctccaactcttgggctcaagtgatcctcccacctcagcctcctgagcagctaggactacagatacatgccaccgctcccggctagtattttttaaaattttttgtagagccaagtgttgctatgttgtccacactgatctggagcttctaatctcaaatgattctcctgcctcagcctcccaaagtgctgggaatacaggtgtgagccaccatacctggccttactgtactaatattaatattgtgtaaataggggaaaataccatggttaatttttactcaaacagtaagaaagtttgagtaactaattttaatctcaacagcccatagctagaagaggggatctaaatgttaagttgaatatttagaaataaaagtgtctacaagaagaaaagtctttagtgaaaatatgggcataggccagcagcattagctttctattgctgcagaacaaattaccacaaacttagctgcttaaaacaacacacacttattgtctcacaatgtttgtgggtcggaagtctaggcgtggcttagctgggtagtctgtttaggatctcagtgctggaaaaacgtgtctggccaggtgctcattgtagctttgacagggaagggatctgctcccaagcactctcaggttgttggcagaatttgtttccttatggctgtaggattcatggcaagttgcttcttccaaaaccagcattggagacagactagcaagatgggcactacactcttagataatcaaataaatgcaatcatgtgcctcgtgtcaccttttttgcattccattcattaagaacaagttgcagttcctacctacactcaaggaagggaggaattacacagaagtgtgaccacaggaggcagggctcatggaggcctccttaaagtcccccagccaaacctgaaaagtcaatcctggaccttatcatagtggctgtatagtttagaaggtttcttcagattggcattcctttgcctcatatcatcacttcaaaaccctataagggtttgttcctcggtcttgactttgtgtctttgaggattgctttgtttagtgtcacctgccttctttcaggaggttttgcctgacatctggtggtgaccgtggccaccaagtcaacccaaacactacctttaaggacgactgcagttctcttagggtctcctcaatctaaaattgtacctctttcaggccaaacacctattttcttcattttttttctcataagaatgctagctagtatgcctaattatctaactggcacagtttcaccaaggacagtttggaactacacaggccattttagggagattttgacatgaacaagattg

SEQ ID NO: 286975 - DNA, 2655 bp, Homo sapiens
agcatcgcgcgcaaggcctgccggttgctcggggtcgtatgacgcacttttccagctcgagccctcacgaggccgtgggtacgaccggaagccgcagactgaatctcgctctgttgcccagcccatctcggcccactgaaacctccacctcccgggttcaagcgattctcctgcctcagcctcccgagtagctgagattacaggcgcccgccaccacgcccagcctctaaagagagcaatcactacacttatggctgggattttgcgcttagtagttcaatggcccccaggcagactacagaccgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccaacagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatggtgagaaagtgttttcattaaaatatgttttcaaaaccattttcaggccgggcacggtggctcacctgtaatcccagcactttgggaggccaaggcgggcagatcacctgaggtcaagagttcgagaccagcctgaccaacatggagaaacccccatctctactgaaaatacagaattagccaggcatggtggcacatgcctgtaacccagctactcgggaggctgaagcaggagaatcacttgaacccgggaggcagaggttgcagtgagctgagatggtgccactgtactccagcctgggtgataggatgagactccatctcaggggaaaaaaaaaaatttttttttcactgactaaacctgctgcagctctcttttactacagacttggagattttagtttaatttggtttaattctctgtcctttccctttcactgtttcactccaaaacatgtaagaatggcaatgtttgaacatctgcgtttgggtctactgccaccttagcaagcctcattaaccattttataaaaattgcgttagtattgttgttgttgtttttgagacagggtcttgctctgtcacccaagctggaatacagtggcatgatttcagttcactgcggcctcgacctcccaggctcaagtgatcctcccacctcagcctccagagtagctgggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctatttcagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggcaactgcagttttaattccatagttattgaatatccagtgtgtgtaaggcctggaggggagccaaaggacactaacttctaagagctccgtctagttggagagaaacctgtgtgccacaacatacagtgtccttgcttatgtggggtcgaagacatctgtgaaaataaaagcagcctctgctaatttagcgc

SEQ ID NO: 286976 - DNA, 3038 bp, Homo sapiens
agcatcgcgcgcaaggcctgccggttgctcggggtcgtatgacgcacttttccagctcgagccctcacgaggccgtgggtacgaccggaagccgcagactgaatctcgctctgttgcccagcccatctcggcccactgaaacctccacctcccgggttcaagcgattctcctgcctcagcctcccgagtagctgagattacaggcgcccgccaccacgcccagcctctaaagagagcaatcactacacttatggctgggattttgcgcttagtagttcaatggcccccaggcagactacagaccgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataaggtttgttgtttcttctcagctctttttaaaatgtattgcctagtgtaattctaaatgcatttttcttttttcgttaatgttctgaaaaaaactttttaaaaaactaaaattttattttgtttttttttaattgacacataataattgtacatatttatggggtacatagtgacgtttcaatatatataaagtatagtgatccgatcagggtaattggcatatccatcatctcagacatttaccatttcttcatgttgggaacattcaacatcctcctcctagctatttgaaactatgtgttattgttaactgtagttatcctgcggggatatagaacgctagaacgtattcctcctatctaaacgcattttcttgtgtcacagaatcaagcccttgaagttgccacaaggacttccaacagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatggtgagaaagtgttttcattaaaatatgttttcaaaaccattttcaggccgggcacggtggctcacctgtaatcccagcactttgggaggccaaggcgggcagatcacctgaggtcaagagttcgagaccagcctgaccaacatggagaaacccccatctctactgaaaatacagaattagccaggcatggtggcacatgcctgtaacccagctactcgggaggctgaagcaggagaatcacttgaacccgggaggcagaggttgcagtgagctgagatggtgccactgtactccagcctgggtgataggatgagactccatctcaggggaaaaaaaaaaatttttttttcactgactaaacctgctgcagctctcttttactacagacttggagattttagtttaatttggtttaattctctgtcctttccctttcactgtttcactccaaaacatgtaagaatggcaatgtttgaacatctgcgtttgggtctactgccaccttagcaagcctcattaaccattttataaaaattgcgttagtattgttgttgttgtttttgagacagggtcttgctctgtcacccaagctggaatacagtggcatgatttcagttcactgcggcctcgacctcccaggctcaagtgatcctcccacctcagcctccagagtagctgggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctatttcagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggcaactgcagttttaattccatagttattgaatatccagtgtgtgtaaggcctggaggggagccaaaggacactaacttctaagagctccgtctagttggagagaaacctgtgtgccacaacatacagtgtccttgcttatgtggggtcgaagacatctgtgaaaataaaagcagcctctgctaatttagcgc

SEQ ID NO: 286977 - DNA, 3483 bp, Homo sapiens
  misc_feature (130)..(130): n is a, c, g, or t
agttctactgcccgctttagcacagtggctgcagctgtgctctgcgggtccctgccctcaagcccggacttcgcccataattctggaagttctcctccgcctcaaccccaggatgaagttgaagcgggtnctctgcgcttccgggaagtggtcatgtgataccccaggcgcctgcgctctctttctagggactttcctgagtgggagggatttcgccggaacaaaaatgcctcagtttggaggtcgcgctcactgcgacggcaggctttgagtgtagcacttggtagttcttcctctgctctgcttcccttcggaggaaaatttcaggctgaaggtttagcgggtgccgcctctaaagagagcaatcactacacttatggctgggattttgcgcttagtagttcaatggcccccaggcagactacagaccgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccaacagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatggtgagaaagtgttttcattaaaatatgttttcaaaaccattttcaggccgggcacggtggctcacctgtaatcccagctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctatttcagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggcaactgcagttttaattccatagttattgaatatccagtgtgtgtaaggcctggaggggagccaaaggacactaacttctaagagctccgtctagttggagagaaacctgtgtgccacaacatacagtgtccttgcttatgtggggtcgaagacatctgtgaaaataaaagcagcctctgctaatttagcgccatctcttttactgtgctaatttttttttctttagagacagggtctcactctgtcgcccagcctggagggcagtggtgtgatcgtagctcactattacctccaactcttgggctcaagtgatcctcccacctcagcctcctgagcagctaggactacagatacatgccaccgctcccggctagtattttttaaaattttttgtagagccaagtgttgctatgttgtccacactgatctggagcttctaatctcaaatgattctcctgcctcagcctcccaaagtgctgggaatacaggtgtgagccaccatacctggccttactgtactaatattaatattgtgtaaataggggaaaataccatggttaatttttactcaaacagtaagaaagtttgagtaactaattttaatctcaacagcccatagctagaagaggggatctaaatgttaagttgaatatttagaaataaaagtgtctacaagaagaaaagtctttagtgaaaatatgggcataggccagcagcattagctttctattgctgcagaacaaattaccacaaacttagctgcttaaaacaacacacacttattgtctcacaatgtttgtgggtcggaagtctaggcgtggcttagctgggtagtctgtttaggatctcagtgctggaaaaacgtgtctggccaggtgctcattgtagctttgacagggaagggatctgctcccaagcactctcaggttgttggcagaatttgtttccttatggctgtaggattcatggcaagttgcttcttccaaaaccagcattggagacagactagcaagatgggcactacactcttagataatcaaataaatgcaatcatgtgcctcgtgtcaccttttttgcattccattcattaagaacaagttgcagttcctacctacactcaaggaagggaggaattacacagaagtgtgaccacaggaggcagggctcatggaggcctccttaaagtcccccagccaaacctgaaaagtcaatcctggaccttatcatagtggctgtatagtttagaaggtttcttcagattggcattcctttgcctcatatcatcacttcaaaaccctataagggtttgttcctcggtcttgactttgtgtctttgaggattgctttgtttagtgtcacctgccttctttcaggaggttttgcctgacatctggtggtgaccgtggccaccaagtcaacccaaacactacctttaaggacgactgcagttctcttagggtctcctcaatctaaaattgtacctctttcaggccaaacacctattttcttcattttttttctcataagaatgctagctagtatgcctaattatctaactggcacagtttcaccaaggacagtttggaactacacaggccattttagggagattttgacatgaacaagattg

SEQ ID NO: 286978 - DNA, 3068 bp, Homo sapiens
taggctaggtacgaggctgggtggtgcaggctgaaggttagcgggtgccgcctctaaagagagcaatcactacacttatggctgggattttgcgcttagtagttcaatggcccccaggcagactacagaccgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaaatacagtggcatgatttcagttcactgcggcctcgacctcccaggctcaagtgatcctcccacctcagcctccagagtagctgggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctatttcagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggcaactgcagttttaattccatagttattgaatatccagtgtgtgtaaggcctggaggggagccaaaggacactaacttctaagagctccgtctagttggagagaaacctgtgtgccacaacatacagtgtccttgcttatgtggggtcgaagacatctgtgaaaataaaagcagcctctgctaatttagcgccatctcttttactgtgctaatttttttttctttagagacagggtctcactctgtcgcccagcctggagggcagtggtgtgatcgtagctcactattacctccaactcttgggctcaagtgatcctcccacctcagcctcctgagcagctaggactacagatacatgccaccgctcccggctagtattttttaaaattttttgtagagccaagtgttgctatgttgtccacactgatctggagcttctaatctcaaatgattctcctgcctcagcctcccaaagtgctgggaatacaggtgtgagccaccatacctggccttactgtactaatattaatattgtgtaaataggggaaaataccatggttaatttttactcaaacagtaagaaagtttgagtaactaattttaatctcaacagcccatagctagaagaggggatctaaatgttaagttgaatatttagaaataaaagtgtctacaagaagaaaagtctttagtgaaaatatgggcataggccagcagcattagctttctattgctgcagaacaaattaccacaaacttagctgcttaaaacaacacacacttattgtctcacaatgtttgtgggtcggaagtctaggcgtggcttagctgggtagtctgtttaggatctcagtgctggaaaaacgtgtctggccaggtgctcattgtagctttgacagggaagggatctgctcccaagcactctcaggttgttggcagaatttgtttccttatggctgtaggattcatggcaagttgcttcttccaaaaccagcattggagacagactagcaagatgggcactacactcttagataatcaaataaatgcaatcatgtgcctcgtgtcaccttttttgcattccattcattaagaacaagttgcagttcctacctacactcaaggaagggaggaattacacagaagtgtgaccacaggaggcagggctcatggaggcctccttaaagtcccccagccaaacctgaaaagtcaatcctggaccttatcatagtggctgtatagtttagaaggtttcttcagattggcattcctttgcctcatatcatcacttcaaaaccctataagggtttgttcctcggtcttgactttgtgtctttgaggattgctttgtttagtgtcacctgccttctttcaggaggttttgcctgacatctggtggtgaccgtggccaccaagtcaacccaaacactacctttaaggacgactgcagttctcttagggtctcctcaatctaaaattgtacctctttcaggccaaacacctattttcttcattttttttctcataagaatgctagctagtatgcctaattatctaactggcacagtttcaccaaggacagtttggaactacacaggccattttagggagattttgacatgaacaagattg

SEQ ID NO: 286979 - DNA, 1368 bp, Homo sapiens
agcatcgcgcgcaaggcctgccggttgctcggggtcgtatgacgcacttttccagctcgagccctcacgaggccgtgggtacgaccggaagccgcagactgaatctcgctctgttgcccagcccatctcggcccactgaaacctccacctcccgggttcaagcgattctcctgcctcagcctcccgagtagctgagattacaggcgcccgccaccacgcccagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtctaccatgatatgggtaatatcaatttgactttctttacaaccaaaaaaaagtatgatagaatggaaaatctgaaattaattgtgagagctctgaatgctgtccaaccccagctggatgtgcaggctaccaaaagatttgaccttttacttgatggacagtttaaaatctcaggaacagcttctaagatcggccggactactgcctatcaccattgcactttattatgtagtactgatgggacgttcctgtcttctttgctaaagagcccttaccaagggatcaggagcaatgccactgctagcataccttccttagtgaaaaatcttttggagtatgctgcctatcatcaaattgataatcacattcacctaataaacccaacggatgagacactgtttcctggaataaatagcaaagccaaagaactgcaaacttgggagtggatatatggcaaaactccaaagtttagtataaatacttcctttcatgtgttatatgaacagtcacacttggaaattaaagtattcatagacataaagaatggaagaattgaaatttgtaatattgaagcacctgatcattggttgccattggaaatacgtgacaaattaaattcaagtcttattggcagtaagttttgcccaactgaaactaccatgctaacaaatatattacttagaacatgtccacaagaccacaaactaaacagtaaatggaatattctctgtgaaaaaattaagggaataatgtgattccaagtaaatgtcttaatacagtttcaattagaaaataaaatgtctcatacttgcacattgtatgtcaaaa

SEQ ID NO: 286980 - DNA, 1718 bp, Homo sapiens
gattaggactatcaatgcttttatttttttcttcttgcttgtctgtattttctcatttttctcgatgaacatttgttacttgtgaattcaacataatttggctttaagatataggtaatgtggctgagtgcagtggctcatgcctgtaatcccagcactttgggaggccaaggtgggaggactgcttgagcccaggagtttgagaccagcctgggcaacatggtgaaatcctgtctgtaagagaaaaaaaaaagatatattacataatgtatttgcagcagacttattgtttgaaaactgtgaaattatttcaactgaaattatttgaaatttgtcttcatttatttcttttgaatacttggttatagcattgctaaagactaattgtaaagctaaaagccaaaagcaactgcactggatactttaagtttggattaaataaccgataattgatagttagaaaatagaatttaatgttccttttctcgatgaattaatttgtttgtcttccatttttaaaagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtctaccatgatatgggtaatatcaatttgactttctttacaaccaaaaaaaagtatgatagaatggaaaatctgaaattaattgtgagagctctgaatgctgtccaaccccagctggatgtgcaggctaccaaaagatttgaccttttacttgatggacagtttaaaatctcaggaacagcttctaagatcggccggactactgcctatcaccattgcactttattatgtagtactgatgggacgttcctgtcttctttgctaaagagcccttaccaagggatcaggagcaatgccactgctagcataccttccttagtgaaaaatcttttggaaaaggatcccactctgacctgtgaagtactaatgaatgctgttgctacagagtatgctgcctatcatcaaattgataatcacattcacctaataaacccaacggatgagacactgtttcctggaataaatagcaaagccaaagaactgcaaacttgggagtggatatatggcaaaactccaaagtttagtataaatacttcctttcatgtgttatatgaacagtcacacttggaaattaaagtattcatagacataaagaatggaagaattgaaatttgtaatattgaagcacctgatcattggttgccattggaaatacgtgacaaattaaattcaagtcttattggcagtaagttttgcccaactgaaactaccatgctaacaaatatattacttagaacatgtccacaagaccacaaactaaacagtaaatggaatattctctgtgaaaaaattaagggaataatgtgattccaagtaaatgtcttaatacagtttcaattagaaaataaaatgtctcatacttgcacattgtatgtcaaaa

SEQ ID NO: 286981 - DNA, 646 bp, Homo sapiens
tggggcgactctagcaggatcttcaactacatcagactattccaagggatcaggagcaatgccactgctagcataccttccttagtgaaaaatcttttggaaaaggatcccactctgacctgtgaagtactaatgaatgctgttgctacagagtatgctgcctatcatcaaattgataatcacattcacctaataaacccaacggatgagacactgtttcctggaataaatagcaaagccaaagaactgcaaacttgggagtggatatatggcaaaactccaaagtttagtataaatacttcctttcatgtgttatatgaacagtcacacttggaaattaaagtattcatagacataaagaatggaagaattgaaatttgtaatattgaagcacctgatcattggttgccattggaaatacgtgacaaattaaattcaagtcttattggcagtaagttttgcccaactgaaactaccatgctaacaaatatattacttagaacatgtccacaagaccacaaactaaacagtaaatggaatattctctgtgaaaaaattaagggaataatgtgattccaagtaaatgtcttaatacagtttcaattagaaaataaaatgtctcatacttgcacattgtatgtcaaaa

SEQ ID NO: 286982 - DNA, 960 bp, Homo sapiens
cgggcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccctcccagctaagagtccgctttggcctgtgcgtggcgtctggccttttcgtcccggtgtctgggcctggcccgg

SEQ ID NO: 286983 - DNA, 799 bp, Homo sapiens
cgggcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagacggggttttgccatgttgcccaggccagtctccaactcctgagcttgagcaacccacccgcctcggcttcccaaagtgctgggaccgcaggcgtgaaccagcgcagccggctggaaaactggaactctcatcggttgagagtggcagctctggagctcggactcccccacctccccaggatttgtcattgctgctgtttgtcgtggttatctgtcaggtagcttttcggcactaattctgtaaaggttgcgttctttcttgtttatggccactgccgtctctgttcagttaactgagataggtggtgatggggcagaaatgttcttgaatgcctggggccagtgagtctcccgtcttttccgggggctgtgtgtgtgtgtgtgtgtgttggggacgccttcagcacttggccaggcagtggacaacccaactgtatgcctgacttcctgcttacacagagcctcaaggtcagccagaagtgagagctcggggctggctcaggtctttcctgagcacggg

SEQ ID NO: 286984 - DNA, 583 bp, Homo sapiens
cgggcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtgtgagtgctgcctccaggcagcgcaggggtgcgggaggcagacctgcagatggcgggaccccagcaggaggaccctgtgatgaaggacggggcgtcctgtgctggccaagggcatggcgtgggaccctgcaagcctgggggccggggagcagccgcctcttccatgggggagggtccttgtgggtatgaacctgggg

SEQ ID NO: 286985 - DNA, 2722 bp, Homo sapiens
cgggcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatgaaaaaaaaaaaaaaaaaaaaaaaaaaaaaaaaaaaaaaaaaaaaaaaaaaaaaaaaataacaaaaaagggacaaaaaaatataagaagataaacagataatgtatgttgtgtacaaaatggtggggcctatatggtagaggtgtattattttatgtagagtgggtacttgggtacgttgtttttaataaaggtgtgagtactgtggataacagtgttagcgtgggaatcttttgtgtgagagaacccttaacttctggggggggggaaacaaataggttggggaaacaaattatacttatagaagaagatatttataaaggtgctcataaggggataaaattattaatactttttagaaagggggtttactaggggggtaaaaaccctgtgagcgtggaataatagatgctagtgacggccgttgacaaagatttgtggcctaataagtggggctattattatatttgtagtgaacaaatattgtttttatacggagagagaatgattgtgtgataataacggttgtgatcatcgaagaaaataatgatctttaccgagcaatacaagcagggtcatgtgttg

SEQ ID NO: 286986 - DNA, 2057 bp, Homo sapiens
cgggcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcctccgtcacagccctcacggacgccaggggccacacggacaccgagggccggcctccctcccccccgcccacctccacccctgaaaagtgcctcagcgtagcctgcctggacaatttggctcgcactccacagatgtctagggtcgcccgcctcttcccctgcccctcttcctctccgcatggccaagtccagccagggaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 286987 - DNA, 2394 bp, Homo sapiens
cgggcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatgaaaacaacaaatacatcataactatatatgagcagcacagtagatagcaagacgaaaacacggggggcggcatagacatctcgggggcacgattatcatcacctctttaaagggcacaagaggattataagcgcgcgacacacaggaggacggctggttgaagcccttcgttggcaccaccgtgtttttttgtgctcttgttcgttctcctgctgctcgcttagtctgccacatacgcaacgaagcatagagctc

SEQ ID NO: 286988 - DNA, 1735 bp, Homo sapiens
cgggcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatgagcctgcctgaccttgacagcagcctggccagtgtgcgtaggcgggcggggggtgagggggaacgagaccagcgggagtgctcacaataccgtctccaccccacagatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 286989 - DNA, 2209 bp, Homo sapiens
cgggcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaaggtgggggcagggccagagggccggcgggggccccacaagggccggggtaactgtgtcctctctctccacactcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 286990 - DNA, 2082 bp, Homo sapiens
  misc_feature (195)..(196): n is a, c, g, or t
cgggcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcagccannacgtcccggccttcctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 286991 - DNA, 2063 bp, Homo sapiens
cgggcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcactcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 286992 - DNA, 1679 bp, Homo sapiens
ggctaggtagcgaggccgggtggttggagcgcccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 286993 - DNA, 2066 bp, Homo sapiens
cgggcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgacagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 286994 - DNA, 1565 bp, Homo sapiens
gattcctagagcatcccatgtctggaaaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 286995 - DNA, 1611 bp, Homo sapiens
ggccagacatggtcacacttacccctgctcctgcatgggggacagggagggtctgtggggctccctcagccctggggctcatgggattgggccccactgacccagcctggtctgttgcagtgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 286996 - DNA, 1511 bp, Homo sapiens
attgctgctagttgactctagagtatcccagctctggaaaagggggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 286997 - DNA, 1553 bp, Homo sapiens
attgctgctagttgactctagagtatcccagctctggaaaagggggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagagggtgggggccgcatcagcccagccatcctgtcccccaatgaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 286998 - DNA, 424 bp, Homo sapiens
accccgagtgccgcgagaggcccgggtgccgctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 286999 - DNA, 2139 bp, Homo sapiens
cgggcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 287000 - DNA, 1611 bp, Homo sapiens
  misc_feature (631)..(631): n is a, c, g, or t
ggtttattagtggttgccgcgtgattctgtgacttctcgctcgttagcgcacgcctcctcatcgtgcttttttttctgtcgccgcctcgcctgctttcatttatcttatctgcctgtctgcgtgtttgtttctccccgcccgcctcttctgtacctccctctctggtgagtgtcttggcgtttgttttgttcctccctgcgcggaggccgtggtgttgtcatgagtatcggcctctcgtgtgcggggtgagtgtgtgggtgttgcgtgcctcatattgtgttggctgccgccccctccccggtgggggtgggtggtcctgtgttcatcacgtgtggtttctgcctctgttgggctgttgttgtctcccgctcgccgcccgtggtttgtgttaaaggtggcgtgccgcgcgtgccgcgctgtttattttatcatcccctccttctgtgggccccgctggttcgcaaaaaacgctggtcgtggtatattgggggccctcctgcgggtgggatctttttggtgccgccccccctccttttttttttttttttgtttttttttttgtcttttttttttttttttttttttttttttttttttttttttttttttttttttttttttttttttttnttttgttgttcatagtcagaattgtattttggatttttacacaactgtcccgttccccgctccacagagatacacagatatatacacacagtggatggacggacaagacaggcagagatctataaacagacaggctctatggctatggcctccatgtgtttcctctgtcccagggtggtgcggtgggtggtgctgcaatgaggaggggcccagggcacagaagggccgggctgcagtggcctcctgggggaagacggatgcttgcagctagctccgtgcctgcccgactccccaggaccagcatgtgcttgcagttctttattgagggaccaggggtgggcgcctcaccttggccctgggggtctctggttgtcacaggaccaccaggaacccccttcccaaggtgttcgcactcggacaggtgatgcggggcgggcacactgtctttctgccagagccagcaccctgtgtaggcacggggaacgggagcctgtcccgtagctttagggttctccactcagcctggtggaggaagggaagggggcctgcgctgggcagtggagcaggctttgctgctttatctggcagcaacagtttgttctcgagctccactggccaactgatagggagaggcacaggagcccatgtgggatggaggagtcggccccacacccatccccccaccaggagctcacccactactgccatcctcagcagggcccaaggagatgcctccatctcagggcccaccagcccccactggggtagagggaggataccaccaagggagcccaccctcccctcacaccaccagttcagcaggttgctgatgaggcccctggtgcagtcctgggaccctgtgcagggcctcctcaaacacctgccttgttgggccatagctgcaggtctggggacaccagggcctggtccagtcttggggtctttaatcaagcagtcaccccagcaaggtaaggcagcag

SEQ ID NO: 287001 - DNA, 2181 bp, Homo sapiens
cgggcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagagggtgggggccgcatcagcccagccatcctgtcccccaatgaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 287002 - DNA, 1973 bp, Homo sapiens
cgggcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 287003 - DNA, 2978 bp, Homo sapiens
cgggcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatggctatggcctccatgtgtttcctctgtcccagggtggtgcggtgggtggtgctgcaatgaggaggggcccagggcacagaagggccgggctgcagtggcctcctgggggaagacggatgcttgcagctagctccgtgcctgcccgactccccaggaccagcatgtgcttgcagttctttattgagggaccaggggtgggcgcctcaccttggccctgggggtctctggttgtcacaggaccaccaggaacccccttcccaaggtgttcgcactcggacaggtgatgcggggcgggcacactgtctttctgccagagccagcaccctgtgtaggcacggggaacgggagcctgtcccgtagctttagggttctccactcagcctggtggaggaagggaagggggcctgcgctgggcagtggagcaggctttgctgctttatctggcagcaacagtttgttctcgagctccactggccaactgatagggagaggcacaggagcccatgtgggatggaggagtcggccccacacccatccccccaccaggagctcacccactactgccatcctcagcagggcccaaggagatgcctccatctcagggcccaccagcccccactggggtagagggaggataccaccaagggagcccaccctcccctcacaccaccagttcagcaggttgctgatgaggcccctggtgcagtcctgggaccctgtgcagggcctcctcaaacacctgccttgttgggccatagctgcaggtctggggacaccagggcctggtccagtcttggggtctttaatcaagcagtcaccccagcaaggtaaggcagcag

SEQ ID NO: 287004 - DNA, 2043 bp, Homo sapiens
tgcggccgcaaagaggggccgagggccgggctaacgccgtcgccgcgccagccttccgggccgcgccgccgcccgctgcgcacacacagccccggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 287005 - DNA, 2395 bp, Homo sapiens
cgggcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgttgcctggcagcaggcttgtttacatggtccgaccctgcaagaccggacagctccggtttgcagaagtaaatcagtgattgtctggagttggagatcagaatctgctgttcacatcccggctgtgacgtcgtgtccgaccgagtcttgctctgtcacccaggttggagtgcagtggtgcgatctcggctcactgcgacctccacctcccgggttcaagcaattctgcctcagcctcccgagtagccaggactacagagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 287006 - DNA, 1307 bp, Homo sapiens
cgggcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagcctgaccagcaccatggcggttggcaagaacaagcgccttacgaaaggcggcaaaaagggagccaagaagaaacgtggttgatccatttttctaagaaagatgggtatgatgtgaaagcacctgctatgttcaatataagaaatattgggaaagacgctcgtcaacaggacccaaggaaccaaaattggatctgatggtctcaagggtcgtgtgttcgaagtgagtcttgctgatttggcagaactc

SEQ ID NO: 287007 - DNA, 1052 bp, Homo sapiens
cgggcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagagacgcgcctaatgggatcctctagatcgcctca

SEQ ID NO: 287008 - DNA, 1645 bp, Homo sapiens
gcgtggtcggcgggaattttgggatcagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 287009 - DNA, 1692 bp, Homo sapiens
ctcctgtcctctcggaaatcccagttgtccaccccctgctcctgcatgggggacagggagggtctgtggggctccctcagccctggggctcatgggattgggccccactgacccagcctggtctgttgcagtgagaatgaggctctgtggcgggaggtggccagccttcggcagaagcatgcccagcaacagaaagtcgtcaacaaggtgggggcagggccagagggccggcgggggccccacaagggccggggtaactgtgtcctctctctccacactcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 287010 - DNA, 1523 bp, Homo sapiens
ctggcggtgatggtcagctctgtcatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 287011 - DNA, 1664 bp, Homo sapiens
  misc_feature (200)..(200): n is a, c, g, or t
gcaggcggcgaagatggcggagaacagcggtcgcgccggcaagagcagcgggagggcgcgggggagggggcggtgtccgcagagcaggtgattgctggcttcaaccgccttcggcaggaacagcgaggcctggcatccaaagcagctgagttggagatggagttgaatgagcacagcctagtgatcgatacactgaaggnggtagatgaaactcgtaagtgctaccgcatggttgggggggtgctggtggagcgaactgtcaaagaggtgctgcccgctttggagaacaacaaggagcagatacagaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatg

SEQ ID NO: 287012 - DNA, 753 bp, Homo sapiens
cgggcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcagtaggtcccacaccagcattatgggccacagcgggtcctggcgcccaccaagaggccccgggtgctgtgggggcagggccctgaccggggccaggtgctcagctc

SEQ ID NO: 287013 - DNA, 903 bp, Homo sapiens
cgcctggatctgcatccgggtccgtgggattcgcgctccactggtcagctggggtcgctctcgggtggttgggtgttgcttgttcccgctgttccagcgtcgaagaaccattgggtctgccgggagtacacctttaggatgctataaaaaactaatagaatatcataagaatggacacctttcttttaaatatgtgaagacctttaatatggatgaatatgtaggacttccaagaaatcatcctgaaagctaccattcttatatgtggaataatttttttaagcatatcgatatagatcctaataatgcacatatccttgacgggaatgctgcagatttacaagcagaatgtgatgcttttgaaaacaaaataaaagaagctggaggaatagatctttttgttggaggaattggtccagatggtcatatcgctttcaatgagcctggatccagtttagtgtcaaggacaagattaaagactctagcaatggataccatcttggcaaatgccaaatattttgatggagatttatcaaaagtgccaactatggctctaactgttggtgtggggacagtgatggatgctagagaagtaatgatccttataacaggggcacacaaggcatttgccctgtacaaagcaatagaagaaggagtcaatcacatgtggactgtttccgctttccagcagcatccccggactatttttgtatgcgatgaagatgctactttagaattaagagttaaaactgtgaaatactttaaagctaatgcatgtgccaataacttgtgggttcctattcgttgagatgggacggagggccagggcaaacatcctgttgacacggcttttcaaggggcaaacatcccgcgctcggcacacggcgcgagaggcgtttcagg

SEQ ID NO: 287014 - DNA, 3003 bp, Homo sapiens
gctagcctgccttaaaccaacccaccctggttccaacccgtcccccccttttatgtaaaaccaaccatcgcccggttcctggaccctagccattcacttaaccacgggccccccccacacaaatgtttaaaaactctttccaaagcccaagcccccaacaaatttttttttttttttttttttgcagtacgtggggatttgttttattcattctcgcttttcatttttgctttttaaatagaacagctttgatttttagtatatgacatcatcatcatgaatttttttctcttactttgtatttaggctccacctcagtagtttgacaaaggtagaatgagttcattttgagtcaaaaccataaaagttactttgtatagacattggttagaatctgtgacatttaacctttcttctggtaacgtttcaggaagtctggtgcatttttatcagaagaattatttctgtttgacttaagtagcaattatttatttatataaaattcgtatgtagaaagttgtcagtttttacctaaagtcacagtaaatatttgacttaatatctaaaaagcaattaatagaattttcaaaataattatttctagtttggaagcagtcctatttgatgtataaaagatatatccaatgtaaagaaaaaaattttataaaggagttgaatttttaatatttactgatattttaatttgcatgtattttaaagctctgtgtattctttccgtaatcaaagttgttagcaaatgacagatgaatactatttaagtagaaaaatgatcctctacaaagtgatactctggaaaatgttgcatcttctaaatcatacagctgatattacccttatctttgttgtcccctctcctactggacatgaagtttcaggtgaccttcaagtaggctgttgagcagttgcaggactagtgaatggaatgcttcccccttccctcctttagagtcccattcttatggttagaatttctcctactacacaaacacttcccagtactctttgcttgtcccttaaaagtgggtctttctcaaagctgggattttagagtcctttttgcagcctttctgacaaggaacatctgtttactaacaagcaacctatctctccaatccagtaatcccatttcctgcaaaaccgcattaagtgcctttccccaccctcccatgttcttaatacctggaaaacttaactcatttctttaccctccaaaatataaaatctctggttcattaactgggtcagtctttttagaacttttttctccccaaagaaatatagtactgaggcattaaaacaggagtaactggaagatcagctatttcccaagcagcttccatagctaagagcagtctgcaagtatatgtaccaattacaaaatgaaagttataatctaccggatttaaaatcgtaatttctattctgaattaaatgatttaatacaggttgttttctgtcttgttttagtaaccctccctcagtgtagaatttgtaatcaacctttgtcataaatacacatgccaaactattggaaagtaatttaccagacgaatggatagggtaatgtattaagagtgagacagcagttctgagcccctggctggagtctagtagaggaactgccagaggatcaatatcaacatagacttttagatataattaaaacctattatctaagtcagtattcaaatttgtcatgcttaatctctttgaagacaagaaatgctcttctggttactcccaaagtacctgtacacattctagatctgcactgttacataattataaattggtatttgctaggtagataaaacttaagacattctgaaacatttctatttgtactttttcaataaacttgactatatcaagatgggaactaaacaggcttactgtgtcttataaaaaatactttgttgtctaaagtaaatgagatagttcaaaattaataaaaacaactagaactgtgctttttttctttaaggtctaatgcatgtgcacaataaacttgtggatccactattcagtatgaaagatggaaactgaaggagactggagcaaaattcagcttgaatgaacagagcactttttactaagtagtagatgaattttcagctatgcaatatgacaaaacatggggaattttgaagattgtcattttttcattcgagtctctatgttaaacattccatattttgaatatttatatcttgtacttgggtttaagagaagtagctggctctcaagattgactggctatttattataaagtactgaagtcacatagccacctataaaacagcatagaaatgtctgcctgtttaaaaagtcattttaaaggtagagtgtccacatcaggcaccatttgtgatatgactccagtggcatatatttcattttttaatgacaagacactccaaacctttcagataacaaactatcattgcagaccttcacttttggaatgcaatctttatattttctgtgcatcacacacatgcttttctgcacgtggttgccttagtcatcttcctacagcaccatctagacatcaaaaattgtgctatatatcattggtaaaggaaatttgaagagatgacagtgcctaaaagtacagtttacatccttttggaaagtatgtgtaagtgcatgttttttgtgcaccttcttctatagcacttttttacaaatatcttatttttatttaacgacttgggttcatgtccctaatataagtatcttgacaattatgagctttatacctagcaagccacttcaggaaattcttttggagaatattttctgattattgttaaacttaatatacaattagctttattccttataaaatgtctaaaagaataatacgaagtatatataaaaggaattactgtaaactacattgccatagcaatttacataaaagtatattgttttctatctttaactcaaataaagcgtgtaataaataagttatctaaa

SEQ ID NO: 287015 - DNA, 2420 bp, Homo sapiens
cgcctggatctgcatccgggtccgtgggattcgcgctccactggtcagctggggtcgctctcgggtggttgggtgttgcttgttcccgctgttccagcgtcgaagaaccattgggtctgccggtttgaacttgttctggaagctgtgcgtcaccgtaatgaggcttgtaattcttgataactatgacttggctagtgaatgggcagccaaatacatctgtaatcgcatcattcagttcaaacctggacaggacagatattttacactgggtttaccaacagggagtacacctttaggatgctataaaaaactaatagaatatcataagaatggacacctttcttttaaatatgtgaagacctttaatatggatgaatatgtaggacttccaagaaatcatcctgaaagctaccattcttatatgtggaataatttttttaagcatatcgatatagatcctaataatgcacatatccttgacgggaatgctgcagatttacaagcagaatgtgatgcttttgaaaacaaaataaaagaagctggaggaatagatctttttgttggaggaattggtccagatggtcatatcgctttcaatgagcctggatccagtttagtgtcaaggacaagattaaagactctagcaatggataccatcttggcaaatgccaaatattttgatggagatttatcaaaagtgccaactatggctctaactgttggtgtggggacagtgatggatgctagagaagtaatgatccttataacaggggcacacaaggcatttgccctgtacaaagcaatagaagaaggagtcaatcacatgtggactgtttccgctttccagcagcatccccggactatttttgtatgcgatgaagatgctactttagaattaagagttaaaactgtgaaatactttaaaggtctaatgcatgtgcacaataaacttgtggatccactattcagtatgaaagatggaaactgaaggagactggagcaaaattcagcttgaatgaacagagcactttttactaagtagtagatgaattttcagctatgcaatatgacaaaacatggggaattttgaagattgtcattttttcattcgagtctctatgttaaacattccatattttgaatatttatatcttgtacttgggtttaagagaagtagctggctctcaagattgactggctatttattataaagtactgaagtcacatagccacctataaaacagcatagaaatgtctgcctgtttaaaaagtcattttaaaggtagagtgtccacatcaggcaccatttgtgatatgactccagtggcatatatttcattttttaatgacaagacactccaaacctttcagataacaaactatcattgcagaccttcacttttggaatgcaatctttatattttctgtgcatcacacacatgcttttctgcacgtggttgccttagtcatcttcctacagcaccatctagacatcaaaaattgtgctatatatcattggtaaaggaaatttgaagagatgacagtgcctaaaagtacagtttacatccttttggaaagtatgtgtaagtgcatgttttttgtgcaccttcttctatagcacttttttacaaatatcttatttttatttaacgacttgggttcatgtccctaatataagtatcttgacaattatgagctttatacctagcaagccacttcaggaaattcttttggagaatattttctgattattgttaaacttaatatacaattagctttattccttataaaatgtctaaaagaataatacgaagtatatataaaaggaattactgtaaactacattgccatagcaatttacataaaagtatattgttttctatctttaactcaaataaagcgtgtaataaataagttatctaaatttccagaagtgaacctgaagaatacatgcattcgactcccaacaattatagtacatgtgaacctgcattcattttgggtttgttaccatcatgcattaggagagttaggttaaaagatgtctttgcctctgtggggagcaaaaaaatgctccttttgcttattttgcatttcataagcccacctggtagaagaagccttacttatctgcttgtctatgtgattaaaatgtagtttcttaaaatattaaaatagcaaataaattaatgaaataaaattggtaatagggttttatggttaaaagtgggggatggggtaaattatgctgctttaattccagatgatgttttaatagccttataaatgttttttaaataactagtgagtaacactccacttacacttccagtaataagaatcatttactacaaactatgctgactaccttagaaagtcatacagcatcacagtgaaaaagctaaaggtacctgttgtgc

SEQ ID NO: 287016 - DNA, 1765 bp, Homo sapiens
cgcctggatctgcatccgggtccgtgggattcgcgctccactggtcagctggggtcgctctcgggtggttgggtgttgcttgttcccgctgttccagcgtcgaagaaccattgggtctgccgggagtacacctttaggatgctataaaaaactaatagaatatcataagaatggacacctttcttttaaatatgtgaagacctttaatatggatgaatatgtaggacttccaagaaatcatcctgaaagctaccattcttatatgtggaataatttttttaagcatatcgatatagatcctaataatgcacatatccttgacgggaatgctgcagatttacaagcagaatgtgatgcttttgaaaacaaaataaaagaagctggaggaatagatctttttgttggaggaattggtccagatggtcatatcgctttcaatgagcctggatccagtttagtgtcaaggacaagattaaagactctagcaatggataccatcttggcaaatgccaaatattttgatggagatttatcaaaagtgccaactatggctctaactgttggtgtggggacagtgatggatgctagagaagtaatgatccttataacaggggcacacaaggcatttgccctgtacaaagcaatagaagaaggagtcaatcacatgtggactgtttccgctttccagcagcatccccggactatttttgtatgcgatgaagatgctactttagaattaagagttaaaactgtgaaatactttaaaggtctaatgcatgtgcacaataaacttgtggatccactattcagtatgaaagatggaaactgaaggagactggagcaaaattcagcttgaatgaacagagcactttttactaagtagtagatgaattttcagctatgcaatatgacaaaacatggggaattttgaagattgtcattttttcattcgagtctctatgttaaacattccatattttgaatatttatatcttgtacttgggtttaagagaagtagctggctctcaagattgactggctatttattataaagtactgaagtcacatagccacctataaaacagcatagaaatgtctgcctgtttaaaaagtcattttaaaggtagagtgtccacatcaggcaccatttgtgatatgactccagtggcatatatttcattttttaatgacaagacactccaaacctttcagataacaaactatcattgcagaccttcacttttggaatgcaatctttatattttctgtgcatcacacacatgcttttctgcacgtggttgccttagtcatcttcctacagcaccatctagacatcaaaaattgtgctatatatcattggtaaaggaaatttgaagagatgacagtgcctaaaagtacagtttacatccttttggaaagtatgtgtaagtgcatgttttttgtgcaccttcttctatagcacttttttacaaatatcttatttttatttaacgacttgggttcatgtccctaatataagtatcttgacaattatgagctttatacctagcaagccacttcaggaaattcttttggagaatattttctgattattgttaaacttaatatacaattagctttattccttataaaatgtctaaaagaataatacgaagtatatataaaaggaattactgtaaactacattgccatagcaatttacataaaagtatattgttttctatctttaactcaaataaagcgtgtaataaataagttatctaaa

SEQ ID NO: 287017 - DNA, 1009 bp, Homo sapiens
  misc_feature (79)..(80): n is a, c, g, or t
aaatttaacttccctaaagggataaaccttcggccggtccattttttttttgaataaaaattagtatgtaaaatatatnntattttttttttcagcttgaatgaacagagcactttttactaagtagtagatgaattttcagctatgcaatatgacaaaacatggggaattttgaagattgtcattttttcattcgagtctctatgttaaacattccatattttgaatatttatatcttgtacttgggtttaagagaagtagctggctctcaagattgactggctatttattataaagtactgaagtcacatagccacctataaaacagcatagaaatgtctgcctgtttaaaaagtcattttaaaggtagagtgtccacatcaggcaccatttgtgatatgactccagtggcatatatttcattttttaatgacaagacactccaaacctttcagataacaaactatcattgcagaccttcacttttggaatgcaatctttatattttctgtgcatcacacacatgcttttctgcacgtggttgccttagtcatcttcctacagcaccatctagacatcaaaaattgtgctatatatcattggtaaaggaaatttgaagagatgacagtgcctaaaagtacagtttacatccttttggaaagtatgtgtaagtgcatgttttttgtgcaccttcttctatagcacttttttacaaatatcttatttttatttaacgacttgggttcatgtccctaatataagtatcttgacaattatgagctttatacctagcaagccacttcaggaaattcttttggagaatattttctgattattgttaaacttaatatacaattagctttattccttataaaatgtctaaaagaataatacgaagtatatataaaaggaattactgtaaactacattgccatagcaatttacataaaagtatattgttttctatctttaactcaaataaagcgtgtaataaataagttatctaaa

SEQ ID NO: 287018 - DNA, 1176 bp, Homo sapiens
cgcctggatctgcatccgggtccgtgggattcgcgctccactggtcagctggggtcgctctcgggtggttgggtgttgcttgttcccgctgttccagcgtcgaagaaccattgggtctgccggtttgaacttgttctggaagctgtgcgtcaccgtaatgaggcttgtaattcttgataactatgacttggctagtgaatgggcagccaaatacatctgtaatcgcatcattcagttcaaacctggacaggacagatattttacactgggtttaccaacagggagtacacctttaggatgctataaaaaactaatagaatatcataagaatggacacctttcttttaaatatgtgaagacctttaatatggatgaatatgtaggacttccaagaaatcatcctgaaagctaccattcttatatgtggaataatttttttaagcatatcgatatagatcctaataatgcacatatccttgacgggaatgctgcagatttacaagcagaatgtgatgcttttgaaaacaaaataaaagaagctggaggaatagatctttttgttggaggaattggtccagatggtcatatcgctttcaatgagcctggatccagtttagtgtcaaggacaagattaaagactctagcaatggataccatcttggcaaatgccaaatattttgatggagatttatcaaaagtgccaactatggctctaactgttggtgtggggacagtgatggatgctagagaagtaatgatccttataacaggggcacacaaggcatttgccctgtacaaagcaatagaagaaggagtcaatcacatgtggactgtttccgctttccagcagcatccccggactatttttgtatgcgatgaagatgctactttagaattaagagttaaaactgtgaaatactttaaagaaatggccctcagctaccacaagttaattcaggagaactaccttctcaattctgtgcaaggctgtgcttcgaaggcaagaaagaagtttgctacagtttgggcttgaattccctgaaaatatcaagatacaagatactgagatgaccattctattatatatcacaaaacttgtaatttaagaccattctatacatcttcatcaagagattttgcgttatgctaataataaaattaaacaaaatgccatgt

SEQ ID NO: 287019 - DNA, 392 bp, Homo sapiens
caaagcaatagaagaaggagtcaatcacatgtggactgtttccgctttccagcagcatccccggactatttttgtatgcgatgaagatgctactttagaattaagagttaaaactgtgaaatactttaaaggtgagcactgaatttcaaaagccgactgagataatctgttgtgagtgacaattaaaacttactgtgactgtggggttaaatctcacactgtgacctattgaaaagtggcaacacatagctagttctttcaagtaatggaaagttctcacctcagataatagtatcttcaaagtagtacctttttttttttttcatgaagagaatctcttcagtctctattttcagtaaacaatttttcttgaaatccaaggtttaataatt

SEQ ID NO: 287020 - DNA, 1924 bp, Homo sapiens
cgcctggatctgcatccgggtccgtgggattcgcgctccactggtcagctggggtcgctctcgggtggttgggtgttgcttgttcccgctgttccagcgtcgaagaaccattgggtctgccggtttgaacttgttctggaagctgtgcgtcaccgtaatgaggcttgtaattcttgataactatgacttggctagtgaatgggcagccaaatacatctgtaatcgcatcattcagttcaaacctggacaggacagatattttacactgggtttaccaacagggagtacacctttaggatgctataaaaaactaatagaatatcataagaatggacacctttcttttaaatatgtgaagacctttaatatggatgaatatgtaggacttccaagaaatcatcctgaaagctaccattcttatatgtggaataatttttttaagcatatcgatatagatcctaataatgcacatatccttgacgggaatgctgcagatttacaagcagaatgtgatgcttttgaaaacaaaataaaagaagctggaggaatagatctttttgttggaggaattggtccagatggtcatatcgctttcaatgagcctggatccagtttagtgtcaaggacaagattaaagactctagcaatggataccatcttggcaaatgccaaatattttgatggagatttatcaaaagtgccaactatggctctaactgttggtgtggggacagtgatggatgctagagaagtaatgatccttataacaggggcacacaaggcatttgccctgtacaaagcaatagaagaaggagtcaatcacatgtggactgtttccgctttccagcagcatccccggactatttttgtatgcgatgaagatgctactttagaattaagagttaaaactgtgaaatactttaaaggtctaatgcatgtgcacaataaacttgtggatccactattcagtatgaaagatggaaactgaaggagactggagcaaaattcagcttgaatgaacagagcactttttactaagtagtagatgaattttcagctatgcaatatgacaaaacatggggaattttgaagattgtcattttttcattcgagtctctatgttaaacattccatattttgaatatttatatcttgtacttgggtttaagagaagtagctggctctcaagattgactggctatttattataaagtactgaagtcacatagccacctataaaacagcatagaaatgtctgcctgtttaaaaagtcattttaaaggtagagtgtccacatcaggcaccatttgtgatatgactccagtggcatatatttcattttttaatgacaagacactccaaacctttcagataacaaactatcattgcagaccttcacttttggaatgcaatctttatattttctgtgcatcacacacatgcttttctgcacgtggttgccttagtcatcttcctacagcaccatctagacatcaaaaattgtgctatatatcattggtaaaggaaatttgaagagatgacagtgcctaaaagtacagtttacatccttttggaaagtatgtgtaagtgcatgttttttgtgcaccttcttctatagcacttttttacaaatatcttatttttatttaacgacttgggttcatgtccctaatataagtatcttgacaattatgagctttatacctagcaagccacttcaggaaattcttttggagaatattttctgattattgttaaacttaatatacaattagctttattccttataaaatgtctaaaagaataatacgaagtatatataaaaggaattactgtaaactacattgccatagcaatttacataaaagtatattgttttctatctttaactcaaataaagcgtgtaataaataagttatctaaa

SEQ ID NO: 287021 - DNA, 1480 bp, Homo sapiens
cgcctggatctgcatccgggtccgtgggattcgcgctccactggtcagctggggtcgctctcgggtggttgggtgttgcttgttcccgctgttccagcgtcgaagaaccattgggtctgccggaattggtccagatggtcatatcgctttcaatgagcctggatccagtttagtgtcaaggacaagattaaagactctagcaatggataccatcttggcaaatgccaaatattttgatggagatttatcaaaagtgccaactatggctctaactgttggtgtggggacagtgatggatgctagagaagtaatgatccttataacaggggcacacaaggcatttgccctgtacaaagcaatagaagaaggagtcaatcacatgtggactgtttccgctttccagcagcatccccggactatttttgtatgcgatgaagatgctactttagaattaagagttaaaactgtgaaatactttaaaggtctaatgcatgtgcacaataaacttgtggatccactattcagtatgaaagatggaaactgaaggagactggagcaaaattcagcttgaatgaacagagcactttttactaagtagtagatgaattttcagctatgcaatatgacaaaacatggggaattttgaagattgtcattttttcattcgagtctctatgttaaacattccatattttgaatatttatatcttgtacttgggtttaagagaagtagctggctctcaagattgactggctatttattataaagtactgaagtcacatagccacctataaaacagcatagaaatgtctgcctgtttaaaaagtcattttaaaggtagagtgtccacatcaggcaccatttgtgatatgactccagtggcatatatttcattttttaatgacaagacactccaaacctttcagataacaaactatcattgcagaccttcacttttggaatgcaatctttatattttctgtgcatcacacacatgcttttctgcacgtggttgccttagtcatcttcctacagcaccatctagacatcaaaaattgtgctatatatcattggtaaaggaaatttgaagagatgacagtgcctaaaagtacagtttacatccttttggaaagtatgtgtaagtgcatgttttttgtgcaccttcttctatagcacttttttacaaatatcttatttttatttaacgacttgggttcatgtccctaatataagtatcttgacaattatgagctttatacctagcaagccacttcaggaaattcttttggagaatattttctgattattgttaaacttaatatacaattagctttattccttataaaatgtctaaaagaataatacgaagtatatataaaaggaattactgtaaactacattgccatagcaatttacataaaagtatattgttttctatctttaactcaaataaagcgtgtaataaataagttatctaaa

SEQ ID NO: 287022 - DNA, 1373 bp, Homo sapiens
cgcctggatctgcatccgggtccgtgggattcgcgctccactggtcagctggggtcgctctcgggtggttgggtgttgcttgttcccgctgttccagcgtcgaagaaccattgggtctgccggtttgaacttgttctggaagctgtgcgtcaccgtaatgaggcttgtaattcttgataactatgacttggctagtgaatgggcagccaaatacatctgtaatcgcatcattcagttcaaacctggacaggacagatattttacactgggtttaccaacagggagtacacctttaggatgctataaaaaactaatagaatatcataagaatggacacctttcttttaaatatgtgaagacctttaatatggatgaatatgtaggacttccaagaaatcatcctgaaagctaccattcttatatgtggaataatttttttaagcatatcgatatagatcctaataatgcacatatccttgacgggaatgctgcagatttacaagcagaatgtgatgcttttgaaaacaaaataaaagaagctggaggaatagatctttttgttggaggaattggtccagatggtcatatcgctttcaatgagcctggatccagtttagtgtcaaggacaagattaaagactctagcaatggataccatcttggcaaatgccaaatattttgatggagatttatcaaaagtgccaactatggctctaactgttggtgtggggacagtgatggatgctagagaagtaatgatccttataacaggggcacacaaggcatttgccctgtacaaagcaatagaagaaggagtcaatcacatgtggactgtttccgctttccagcagcatccccggactatttttgtatgcgatgaagatgctactttagaattaagagttaaaactgtgaaatactttaaagaaatggccctcagctaccacaagttaattcaggagaactaccttctcaattctgtgcaagggtgagtttcagttgcacttctgttatatacaattcaaagagataaatcccaccaatatatttaataaatagctggtgatccctcatataatgaatagtacaactgacatttaaacattaattgtacttttagaaagtgaaatagcaacactgttgtctcattgtaattaccttatttataactggaattaccgatagctgtgcttcgaaggcaagaaagaagtttgctacagtttgggcttgaattccctgaaaatatcaagatacaagatactgagatgaccattctattatatatcacaaaacttgtaatttaagaccattctatacatcttcatcaagagattttgcgttatgctaataataaaattaaacaaaatgccatgt

SEQ ID NO: 287023 - DNA, 627 bp, Homo sapiens
catcaggaaacaactcatacctaaccacaggaagttgacttaccatggttggacttccattaaattcaagaaaaatacaaatgtttgtcactattggtagatcagaattttcaaaagaaaatgctacatagtggatgaattcaatgcaattaaggagtcaagtgtcctcgactggcaaccagaagactacatctggcagttgtaccatttagactgtggtcaagtcccaagctcttttctctatgtaaagaaaacaaaacgcagcacattcacattttcccgaggaactgtaaagatgatctctacagggataaacgttgtaaagcctgaagctcaatcaactgatgttggaaactctcaaagggagtaaaggcttgatctcaatggtctagaacatgtactgtaatttaatagaagagatggtcgtcttaatatttaatgatttaaaagaacttcccagtccatgcgaagagtacagtccaagaataaatcaaatttctgaacgcattttatgctacatatgtgtatactttgcgatcctcaggtgttcgtgccaaatattctctctcaataagtccttcaatacgtttcttaataacaactggacttggtaagaatcgcgccttc

SEQ ID NO: 287024 - DNA, 900 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtatcatatgtttcttacaaagtggaggtttgtggcagccctgcatggagcaagtctgtcagcaccatctttctaacagtatgtgctcacttcatgtctctctcacattttggtaattcttggaatgtttccgttattaaatcagttatagtgatctgtgattagtgatctttgatattactgtcataattgcttggggggcaccatgaaccacccctatataagacagcaaactgagtcgataaatgttttatgtgttctgaccactgcactgaccagctgcctccctatctctctccttctgctcagacctccctatccttgagacacagcaatactgaaattaggggccaggcatggtggtggctcatgcctgtagtcccagctacttgggagactgaagcaggaggattgcttgagcctaggagttcgaggctgcagtgagctgtgatcacgccactgcacttcagcatgggcagcaaagcaagaccctgactc

SEQ ID NO: 287025 - DNA, 985 bp, Homo sapiens
aaaaaagttttcctgtggtttaaaaaaaatctttcatgaaaagaattgtcaatcaacgtgacaaatttcattattgtcttattttaagaaactgcaacagccaccccaactttcaagcaccaccttgatcaacagccatcaacattgaggcaaaaccctccaccagcaaaaagattatgactcattgaaggctcagctgatggttagcagtaaaaaatattaactttaatcatctcgaccattcagtactcatctaatattctctataacaaaatgggaaatgcacataaagcacttctgctacatgctgaattatgattgttgtctccaggaaaagaacttgtgggaacgtttgagttgtaagctgaactaactagctgcttttttcatgaaataccgcttttactggaaagaactgacagataaactgaggtattcaaacctagatatttggcagacattttcgtgaaaataaatatgttcgtgccacttcaaggaacataattctcagtacttgttgccaataatgttggaattttcatgcaaaaattcaaataaaaaacaaacttaaaaccatcaagaacttggtgactttatgtggaagccagtgctacaatactttagcttcccaatacttaaaaacttttctgatgagattactagtgatattaacaatgtgattgatattgaataatgaaatgttttagcatttggaagatctgtttaattcagtaaatcagtattttccaaatgaccaatgcatgacatttcaacatcacgcacaggaaaataggcattcgaggtacagtcaaaaataatgagttttaatgtaacaagtacaaaatgtccattgaagtggtttcaaattccaaatagtaattggaaaatccaccactcgtgttttggggtagtagtatcgaaaaagaataaccaagataatttgaaaaggctattaaaaaatacttctcaattttcaaactgcata

SEQ ID NO: 287026 - DNA, 397 bp, Homo sapiens
gtcaggaaatattgtagggcagtggtcctcagttgggggttgactctgtcccctaggggcatctggcaacatccggcataactgtgggtgtcacatgagagggacgctgctcaccatcctgcaatgcacagcacagaccccaccacaggggttttatccagcccaaagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagtta

SEQ ID NO: 287027 - DNA, 775 bp, Homo sapiens
cattctgaattcttggagccaaggtcacaaagggaaatcctgtgaatggcataattttatattctgcataaagtgagtttacacaatgagtgcaacctaatacaacagcaagaaaaaataagaactagtaagcaattgggcaatatgtataatttacatatttatctttaatctgtattatctacactttgatcttttttggttaaagaagtattaataaggaacctacctacaaatgtagtctgtttcacaacataattactgatagcccattataaccaattttaaaatccttaaaataattactgatagcccattataaccaattttaaaatccttaaaataattactgatagcccattataactgattttaaaatccttaaaaatcatttcatttttcagttacttataaaactttttcttgatctttcagacctactttgaagaaaagttgatctgtctctgtattaccattttccaggttgttttacgaatacgtgttgtagtcatccattaagcaatccagccgagcttgaggaaagtgacgcccttggagtgaggcgagcagcacagagacggctgaaagctgagctaggaattcccttggaagaggtaaccagctctcctacacaaccatacaagctgaaacctaaacatactataaaaaggtttttaataaaatttttaaattcaaatgtagttctctgcttggtaacctccggagttatgagttagccccacaaaccatcttgaataaagattatttaaatttt

SEQ ID NO: 287028 - DNA, 6432 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccatgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttattttgctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacaaaactgcaacagccaccccaactttcaagcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagcccgggcgtggtggcgcatgcctgtaattccagctacttgggaggctgagacgggaccattgcctgaacccggtcggcggaggtttctgtgagtggagactgcaccattgcactcaagcctgggcaacacagaatgaaactgtctccaaaataaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcgggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagtta

SEQ ID NO: 287029 - DNA, 4369 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtatcatatgtttcttacaaagtggaggtttgtggcagccctgcatggagcaagtctgtcagcaccatctttctaacaaaactgcaacagccaccccaactttcaagcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagcccgggcgtggtggcgcatgcctgtaattccagctacttgggaggctgagacgggaccattgcctgaacccggtcggcggaggtttctgtgagtggagactgcaccattgcactcaagcctgggcaacacagaatgaaactgtctccaaaataaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcgggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagtta

SEQ ID NO: 287030 - DNA, 6555 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccatgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttattttgctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacaaaactgcaacagccaccccaactttcaagcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagcccgggcgtggtggcgcatgcctgtaattccagctacttgggaggctgagacgggaccattgcctgaacccggtcggcggaggtttctgtgagtggagactgcaccattgcactcaagcctgggcaacacagaatgaaactgtctccaaaataaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcgggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagttaaatgtttgttaaattcaatagaatgactcatttatggttaactttgggcaatttataatttcagacaagactgtttagcaagtattttattgaaaagtaaaaaaaattgcaatttaatactgt

SEQ ID NO: 287031 - DNA, 6417 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccatgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttattttgctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacaaaactgcaacagccaccccaactttcaagcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagcccgggcgtggtggcgcatgcctgtaattccagctacttgggaggctgagacgggaccattgcctgaacccggtcggcggaggtttctgtgagtggagactgcaccattgcactcaagcctgggcaacacagaatgaaactgtctccaaaataaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcgggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagtta

SEQ ID NO: 287032 - DNA, 6259 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccatgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttattttgctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacaaaactgcaacagccaccccaactttcaagcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagcccgggcgtggtggcgcatgcctgtaattccagctacttgggaggctgagacgggaccattgcctgaacccggtcggcggaggtttctgtgagtggagactgcaccattgcactcaagcctgggcaacacagaatgaaactgtctccaaaataaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcgggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagtta

SEQ ID NO: 287033 - DNA, 6257 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccatgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttattttgctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacaaaactgcaacagccaccccaactttcaagcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagcccgggcgtggtggcgcatgcctgtaattccagctacttgggaggctgagacgggaccattgcctgaacccggtcggcggaggtttctgtgagtggagactgcaccattgcactcaagcctgggcaacacagaatgaaactgtctccaaaataaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcgggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagaaaaaaaatatattattttattataattttgcggcgcaattcgggttaacttgg

SEQ ID NO: 287034 - DNA, 6069 bp, Homo sapiens
  misc_feature (6028)..(6028): n is a, c, g, or t
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccatgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttattttgctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacaaaactgcaacagccaccccaactttcaagcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagcccgggcgtggtggcgcatgcctgtaattccagctacttgggaggctgagacgggaccattgcctgaacccggtcggcggaggtttctgtgagtggagactgcaccattgcactcaagcctgggcaacacagaatgaaactgtctccaaaataaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcgggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgctatngaacttctaactaggggtaccggctcgattcgtatctgtat
